US010485196B2

(12) United States Patent
Fu et al.

(10) Patent No.: US 10,485,196 B2
(45) Date of Patent: Nov. 26, 2019

(54) RICE PLANTS WITH ALTERED SEED PHENOTYPE AND QUALITY

(71) Applicant: The Institute of Genetics and Developmental Biology Chinese Academy of Sciences, Beijing (CN)

(72) Inventors: Xiangdong Fu, Beijing (CN); Shaokui Wang, Beijing (CN); Kun Wu, Beijing (CN); Qian Liu, Beijing (CN); Shan Li, Beijing (CN)

(73) Assignee: THE INSTITUTE OF GENETICS AND DEVELOPMENTAL BIOLOGY CHINESE ACADEMY OF SCINCES, Beijing (CN)

(*) Notice: Subject to any disclaimer, the term of this patent is extended or adjusted under 35 U.S.C. 154(b) by 0 days.

(21) Appl. No.: 15/548,562

(22) PCT Filed: Feb. 3, 2016

(86) PCT No.: PCT/GB2016/050247
§ 371 (c)(1),
(2) Date: Aug. 3, 2017

(87) PCT Pub. No.: WO2016/124920
PCT Pub. Date: Aug. 11, 2016

(65) Prior Publication Data
US 2018/0020629 A1    Jan. 25, 2018

(30) Foreign Application Priority Data
Feb. 3, 2015  (WO) ................ PCT/CN2015/072156

(51) Int. Cl.
| C12N 15/82 | (2006.01) |
| A01H 5/10 | (2018.01) |
| C12Q 1/6895 | (2018.01) |
| A01H 5/00 | (2018.01) |
| C07K 14/415 | (2006.01) |

(52) U.S. Cl.
CPC ............... *A01H 5/10* (2013.01); *A01H 5/00* (2013.01); *C07K 14/415* (2013.01); *C12N 15/8218* (2013.01); *C12N 15/8261* (2013.01); *C12Q 1/6895* (2013.01); *C12Q 2600/13* (2013.01); *C12Q 2600/156* (2013.01); *C12Q 2600/158* (2013.01); *Y02A 40/146* (2018.01)

(58) Field of Classification Search
None
See application file for complete search history.

(56) References Cited

U.S. PATENT DOCUMENTS 9,359,615 B2 * 6/2016 Morel ................. C07K 14/415

OTHER PUBLICATIONS

Lee et al, Development, Aug. 2006, vol. 133, pp. 4305-4314. (Year: 2006).*
Mao et al, PNAS, Nov. 9, 2010, vol. 107, No. 45, pp. 19579-19584. (Year: 2010).*
TAIR Locus AT3G02170, 2006 (Year: 2006).*
UniProt_Accession_No._Q6YW00_ORYSJ_July_5_2004 (Year: 2004).*
Ohyanagi H. et al., Nucleic Acids Res. 34:D741-D744 (2006). (Year: 2006).*
Fan C, et al. (2006) GS3, a major QTL for grain length and weight and minor QTL for grain width and thickness in rice, encodes a putative transmembrane protein. Theor Appl Genet 112:1164-1171. (Year: 2006).*
Xianjin Qiu et al., "Mapping and characterization of the major quantitative trait locus qSS7 associated with increased length and decreased width of rice seeds", Theor Appl Genet (2012) 125:1717-1726.
XP-002756789, http://ibis.internal.epo.org/exam/dbfetch.jsp?id=EM_STD:AP005807, Apr. 14, 2016; 11:45.
Chuchuan Fan et al., "GS3, a major QTL for grain length and weight and minor QTL for grain width and thickness in rice, encodes a putative transmembrane protein," Theor Appl Genet (2006) 112: 1164-1171.
Yong Zhou, et al., "Natural Variations in SLG7 Regulate Grain Shape in Rice", XP009189554, Genetics, vol. 201, 1591-1599, Dec. 2015.
Yuexing Wang et al., "Copy number variation at the GL7 locus contributes to gain size diversity in rice", XP-002756791, Nature Genetics, vol. 47, No. 8, Aug. 2015, pp. 944-949.
Shaokui Wang et al., "The OsSPL16-GW7 regulatory module determines grain shape and simultaneously improves rice yield and grain quality", XP-002756790, Nature Genetics, vol. 47, No. 8, Aug. 2015, pp. 949-955.
XP-002756787, http://www.ricedata.cn//variety/varis/607525.htm, China Rice Data Center, Apr. 19, 2016 16:18.
XP-002756788, http://ibis.internal.epo.org/exam/dbfetch.jsp?id+EM_CDS:BAF22126, BNSDOCID XP 2756788A, Apr. 19, 2016 15:39.

* cited by examiner

*Primary Examiner* — Eileen B O Hara
(74) *Attorney, Agent, or Firm* — Greer, Burns & Crain, Ltd.

(57) ABSTRACT

The invention relates to plants with an improved organ phenotype. In particular, the invention relates to rice plants which have better grain quality and altered seed phenotype due to increased expression of GW7 (LOC_Os07g41200) or due to a combination of increased expression of GW7 and reduced expression of GS3 (OsSPL16). Grains show increased length and increased slenderness.

Figure 1:
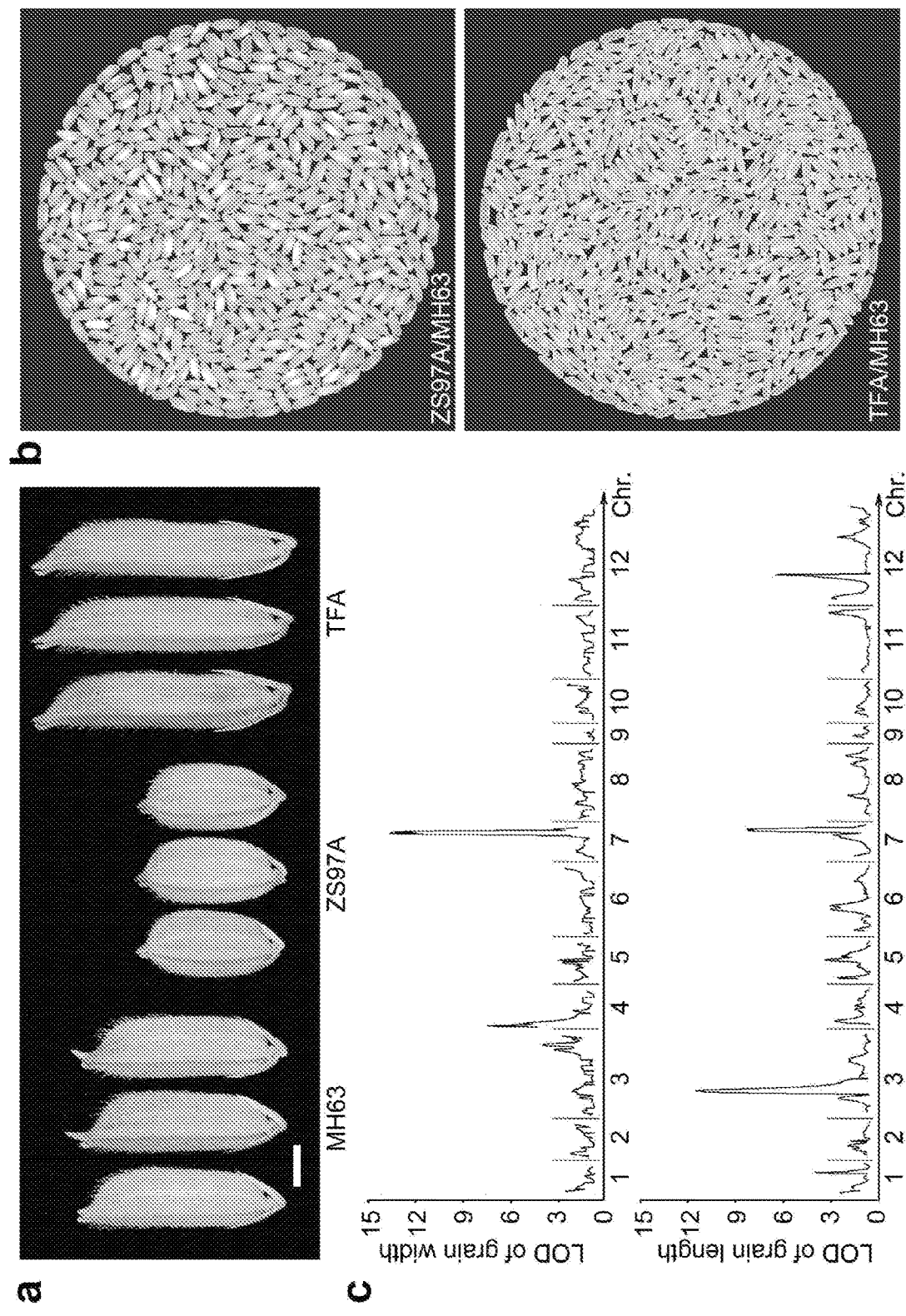
Figure 1:
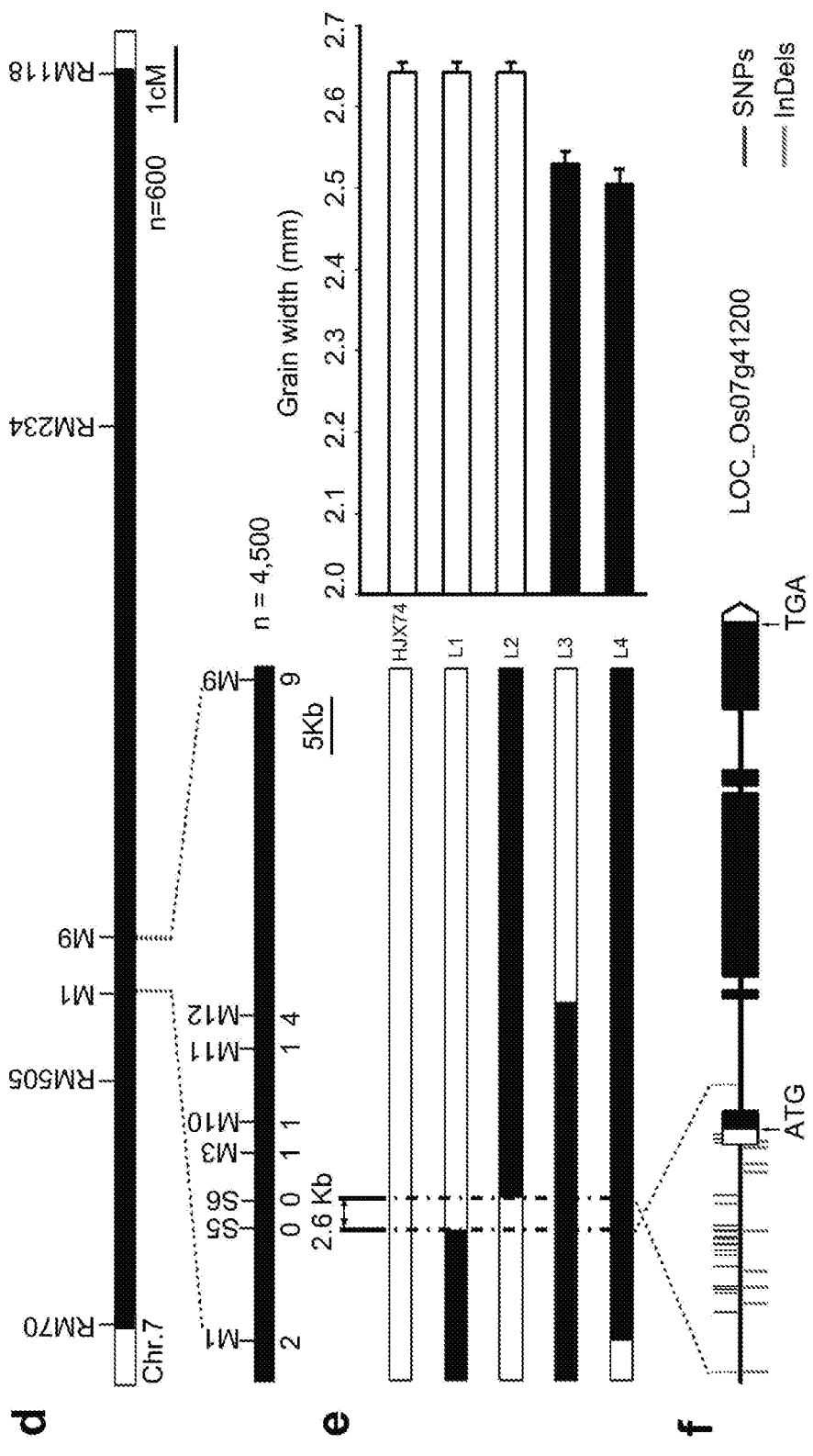

17 Claims, 26 Drawing Sheets
Specification includes a Sequence Listing.

a b c f

SEQ ID NO: 432
SEQ ID NO: 433

HJX74 ATTGACACA..................CCATACCACATCTC -131
TFA   ATTGACACATATCTCATCATACCATCACCATACCACATCTC -120

HJX74 ATCTCACGCGTCCCAAAGAAAGTGATAGTGTACGTACCTCT -90
TFA   ATCTCACGCGTCCCAA..........GTGTACGTACCTCT -90

SEQ ID NO: 434
SEQ ID NO: 435

| | | | | | | | |
|---|---|---|---|---|---|---|---|
| GST | − | + | − | − | − | − | − |
| GST-OsSPL16 | − | − | + | + | + | + | + |
| Bioltin probe | + | + | + | + | + | + | + |
| Competitor | − | − | − | ◢ | | | ◣ |

Bound probe →

Free probe → b

| | | | | | | | |
|---|---|---|---|---|---|---|---|
| GST | − | + | − | − | − | − | − |
| GST-OsSPL16 | − | − | + | + | + | + | + |
| Bioltin probe | + | + | + | + | + | + | + |
| Competitor | − | − | − | ◢ | | | ◣ |

Free probe →

Fig.15

SEQ ID NO:1 cDNA OsGW7

ATGCCTCCGGCGAGGGTGCTCGGCGGCGGTGGTGGAGGAGGGGGGTTGGGGGACGAGGCGCCGGAGCTGGAGAGGCAGATGG
GGTGCATGGCCGGCATCTTCCAGATCTTCGACCGCCGCCAGCGCCTGCTCACCGCGCGCCGCCGCCGCCCGCCGCCCAAGATGCTG
CCCCCGGGCCCAGGCCATACTCTTCCAAGAAGCAGCAGCAATGTTGCAGCGCAGAGCTCAAGTACCTCCAAGATCGTTCTGGAGAA
AACATTCAGCAAGAGCATGACCGAGAACAGTAGCCTTTCAATAGAGTCATCAAGGGCTTCCTGTTCTTCCTCCTCATGCTCATCCTTT
TCATCACTTGATGGCAACAAATCGATCCAACAAGAGCTGCCATACATCAACGAGCAGCTCTTTGTACAGAGGCCACTGAAGAGCTC
ACCAAGTCTGAAGGACCCAGTCATGGACACCAGGTCTGGACAGTCAAACATTGGCTTCAGAGACATTGTGAAGGACTCCATTAACC
GGGACACCGGAGGCCTTACTGTCAAGACCTCGGTGAAGGATGCAAGGAGGAATGGGCAGTACAAAGACTCACCAAGGCCCTTGC
TGCTCTCCAAATCAATGGATGGGACCTACGTCATCGGGATCGATAGGAGCACCAAGGTCCCTGCTAATGCTGTTGAATCCAGCAGG
CGATTCCCAGAGCAGTCGCGCTTCATGCGATGATCGGCGGCTCCTGAGGCCAGTTGAAGCTCAAGAGAACAAGAAGCCTTCCAC
AAGGCTCAAAGAGCTTCCCAGACTGTCCTTGGACAGTAGGAAAGAAACCCTGAGCTCGAGTTCTCGCCAGAAGACCTTCAGTTACA
GGAGAACCGACGACAGTCTCATGGACGCTCTTAGGCCTCAAGATTCCCCAGGCCATAGGCGTGCCAGCAGTGTCATTGCCAAGCTG
ATGGGGTTGGAAGAAGCACCCAATGCTACAGGGGTGCTAACTGTTGATAGCTACGAGCCTGAAAGATCACCAAGACCAGCAGAAG
ACACACAGAAGGAGCATCCAGTACCTTCCCCTAGAAGATTTTGTCAGGATCCACGCGAGTCGCTGCCAAAAGATGAGTCTCCGGCA
ATGAAAACCAAGCCTTCTCCAAGAATTCTTACTGAATCTGCTCCTTGGAGGCAGCAGGAGAAGATTGCCACCAGTAGCAAGGCTTC
ACAATGCCGAGATGCTGAAGTTCGACCAAGGACTGCATCTCTCTATGCCTACATTGAGAGAAGGGGCGGGGGGCTTGAGTTCTTG
GAGTGCAACAAGGACTTCAGGGCTCTCAGGATACTGGAAGCGCTGCACGCAAAGGATGCCAAGCGCCAGAACGATGGCAATGGC
GCATTAACAGTGGCTGCTCAGCAGGCAGGGGATGCACTGAACACCAGTTCCAGACACTTCCAGCCTCCCATTGTAGTCATGAAGCC
AGCAAGAAGCACTGAGAAGCAGCCAGGGGTTTCACTTGCTTCAGTTGATCCCCTTGCAGGGTTCAGAAACCTCAGGAAGCTGCAG
GCCAGAGATGCGCCTTGCATTGGCGAGCATGAGACCAGCACAAATGAGAAGGTCCATTCTCGCATTTCAAGGGCACAATCCAAGTC
CGATGAACCTGCTAGCCGTGCAAGCTCTCCAAGGCCTACAGGATCATCAAGCCCCAGGACAGTGCAGCGGAAGGCAGAGTCAGAA
AGGAGGTCTCGTCCACCTGTCTCACCGAAGTCCCCAAGCAAGAAGTCCAGTGAAGCAGCCTCTCCTGGAGGAAGAACAAGAACAA
AGCCTTCTCAAGGGAAGAACCACCGTGACAATGAGGTCTCGAAGAGTCCAAGAAGCAGAATCAGCATGGTGAAGGAGATCGACAT
AAGCATCATGGATTTTCAAAAGCCCCTAGCATCGACACCAAGTCACAAGGGAACTCCTTCAGTTCTTGCTTCAGATCAGAAGATTAA
TTCACTGGAGAATGCCCCAAGTCCCATCTCTGTCCTCGACACGTCATATTACCATACAAGACTGTCATATTCATTCAAAGATGGGGA
GACACATTCTTCAGAGGAGTGCTGGAACCCGAACAGCCTGCCTGACACGCCACAGTCCAAGACGAGCAGTGAAGTCAGCCAGATC
AAACCAGAAAATTTTGAGGCCCTCATCCAGAAGCTTGAGCAATTGCAGTCAATGATGATGAAGTTGCAAACAAGAAAGATCATCA
GTACATTTACGAGATACTCTTAGCATCTGGCCTCCTGCACAAAGAACTTAGCTTCGTAGCCATGCCTGGTCAAGCATGGCCATCAAG
CTGCCTGATCAATCCAGAGCTCTTCCTCATTCTTGAACAAACAAAGCCAGATTTTGCTTCAGCAGACCAAACTGTTACCAAGAGCTCC
AAAGCTAACACAGAAAAGCTTCATCGAAGAATTGTATTCGATCTGGTAAACGAAATTACAGCTCAGAAGATGAACATTCATTGCTC
GGCAAGTCAGTCAGCCAAGTCGCTTCAATTAAGGAAGTACAACGGATGGCGACTTTTTAAGGACCTGTGCACAGAGGTTGACAGG
CTTCAATCTGAGAGTTCAGCGATAAAATGCTCTGAAGAGGATGGGGATGAAAGAATGCTATTGGTTGAGGATCCACTGAATGGAA
TAGAAGATTGGAGCTTCGATAGTGAATCGCCAAGCACGGTTTTGGAGATCGAAAGATTAATCTACAAGGACCTCATTGACGAGGTC
ATATGGGATGAGGCCACAGGGAAGATGCAAGGTGGACAGTGGAACCTAAAGAGGCAGCTGTCATTTAGTAGTACAAGCTGA

SEQ ID NO:2 gDNA OsGW7

CTGCATGGCATTCGCACGCCATTGACACATATCTCATCATACCATCACCATACCACATCTCATCTCACGCGTCCCAAGTGTACGTACC
TCTGCTTGCTCCTTGGCTTTCTGAGCTGAGCTGCTCTGCAGTTGGATGTGCGTGAGCTGGTGATCTGGGAGGAGTCGGAGTCGGAG
GGGGAGATGCCTCCGGCGAGGGTGCTCGGCGGCGGTGGTGGAGGAGGGGGGTTGGGGGACGAGGCGCCGGAGCTGGAGAGG
CAGATGGGGTGCATGGCCGGCATCTTCCAGATCTTCGACCGCCGCCAGCGCCTGCTCACCGCGCGCCGCCGCCGCCCGCCGCCCAA
GATGCTGCCCCCGGGCCCAGGTTAACGGCGCATTTTTTTTTCTCTGCACATTTCTTCCTGTGGCATCTGCTCCTCTTCCCCTGTTCTGT
TTTCACAATCACCAGCTTCACTCCATTCACACACCCAAGATCATGTCAGCTGCGTCTCAAGCATTTTTACAAGCTGTTTCTCTTTTCTTT
TCCCTCTCTATCTTGGTTACTGTTTTTAAGTATTATTACTACTGTTTTACTGTTTTTAAGCCATCTGTTTTTAAGTGTTACTTTCTGAATT
ATTAGCTGCAACTCGTTCTGCAAATGTTGACCAGAGATTAGAAAAGTTGGGTGCTTCTTTTGTGGGACAGAGAACTACTAATTTCAT
GTGTTGGTTGAAACTCGAGAGACAAGTCCTTTCAGACTATTATTCAAAGTTTGGTAACAGATAACAGTTGGAAGGTGCAGTAGAAC
ATGCATTGGTTGGTAAAGCAGTTTATTGCTAGTAGAAAGTTTTTTTTTTTAAAAAAAATGCTATTAATTGGAAAATGGGAGTTTTCTTC

Fig.15 cont.

ACTTCTTCACAACTGCAGGATACTAATTTCATCTTTAACCTTCTTTTATTGAAAACAGAGTACCCCCCTCACCCTAGATAAAAGACAAC
AGTACAAAAAAACAGATGGCTTACAGTAGTTGTGATCATAAAGGCCTTTCTTTAAAGAATGTAATATGGCAGCACACATTGACATA
AGGACAGGCACTGACGTGGATTTGGGTGCCCAGAAGTAGCATGAGGGGATAACTTTCGCACTGACTGAAAAGGACAGATTATCA
GTTAGTTACTAAAATTTTCATTAATATAATGAAACTGAAGAGGACAGCTTAACATTTGGTTTTAAAATTTCCATTCTCGTCAATGATA
AATTAACTGAAGAAGACAGCTTAACAATTGATTATAAAACTTCCATTCATGTATATGATTAATTGATTATATTATTGAACAACAATTA
AGAAAACACACACCTTTTCACCGCTCAAATCCATCCATTTTGCTCATACCAGACTGTCTTAATAAATAGCTATAATTCCTCAATTCACA
GTTTAGGCTGTAATTATAATGTCTTCTTTTTTTTCTTTTCTAGGCCATACTCTTCCAAGAAGCAGCAGCAATGTTGCAGCGCAGAGCT
CAAGTACCTCCAAGATCGTTCTGGTAATTTTCCTATTCGAACTCCAACTGTTGTTTGTTACCACTTGCCAGTAAAAAAACCATCCCAT
GCATGCATCAGAAGTATACTTTGGCCACATCAAGAAGAGTACTCTAACTTATGGATTGCCTTTGCAGGAGAAAACATTCAGCAAGA
GCATGACCGAGAACAGTAGCCTTTCAATAGAGTCATCAAGGGCTTCCTGTTCTTCCTCCTCATGCTCATCCTTTTCATCACTTGATGG
CAACAAATCGATCCAACAAGAGCTGCCATACATCAACGAGCAGCTCTTTGTACAGAGGCCACTGAAGAGCTCACCAAGTCTGAAGG
ACCCAGTCATGGACACCAGGTCTGGACAGTCAAACATTGGCTTCAGAGACATTGTGAAGGACTCCATTAACCGGGACACCGGAGG
CCTTACTGTCAAGACCTCGGTGAAGGATGCAAGGAGGAATGGGCAGTACAAAGACTCACCAAGGCCCTTGCTGCTCTCCAAATCAA
TGGATGGGACCTACGTCATCGGGATCGATAGGAGCACCAAGGTCCCTGCTAATGCTGTTGAATCCAGCAGGCGATTCCCAGAGCA
GTCGCGCTTCTCATGCGATGATCGGCGGCTCCTGAGGCCAGTTGAAGCTCAAGAGAACAAGAAGCCTTCCACAAGGCTCAAAGAG
CTTCCCAGACTGTCCTTGGACAGTAGGAAAGAAACCCTGAGCTCGAGTTCTCGCCAGAAGACCTTCAGTTACAGGAGAACCGACGA
CAGTCTCATGGACGCTCTTAGGCCTCAAGATTCCCCAGGCCATAGGCGTGCCAGCAGTGTCATTGCCAAGCTGATGGGGTTGGAAG
AAGCACCCAATGCTACAGGGGTGCTAACTGTTGATAGCTACGAGCCTGAAAGATCACCAAGACCAGCAGAAGACACACAGAAGGA
GCATCCAGTACCTTCCCCTAGAAGATTTTGTCAGGATCCACGCGAGTCGCTGCCAAAAGATGAGTCTCCGGCAATGAAAACCAAGC
CTTCTCCAAGAATTCTTACTGAATCTGCTCCTTGGAGGCAGCAGGAGAAGATTGCCACCAGTAGCAAGGCTTCACAATGCCGAGAT
GCTGAAGTTCGACCAAGGACTGCATCTCTCTATGCCTACATTGAGAGAAGGGGCGGGGGGCTTGAGTTCTTGGAGTGCAACAAGG
ACTTCAGGGCTCTCAGGATACTGGAAGCGCTGCACGCAAAGGATGCCAAGCGCCAGAACGATGGCAATGGCGCATTAACAGTGGC
TGCTCAGCAGGCAGGGGATGCACTGAACACCAGTTCCAGACACTTCCAGCCTCCCATTGTAGTCATGAAGCCAGCAAGAAGCACTG
AGAAGCAGCCAGGGGTTTCACTTGCTTCAGTTGATCCCCTTGCAGGGTTCAGAAACCTCAGGAAGCTGCAGGCCAGAGATGCGCCT
TGCATTGGCGAGCATGAGACCAGCACAAATGAGAAGGTCCATTCTCGCATTTCAAGGGCACAATCCAAGTCCGATGAACCTGCTAG
CCGTGCAAGCTCTCCAAGGCCTACAGGATCATCAAGCCCCAGGACAGTGCAGCGGAAGGCAGAGTCAGAAAGGAGGTCTCGTCCA
CCTGTCTCACCGAAGTCCCCAAGCAAGAAGTCCAGTGAAGCAGCCTCTCCTGGAGGAAGAACAAGAACAAAGCCTTCTCAAGGGA
AGAACCACCGTGACAATGAGGTCTCGAAGAGTCCAAGAAGCAGAATCAGCATGGTGAAGGAGATCGACATAAGCATCATGGATTT
TCAAAAGCCCCTAGCATCGACACCAAGTCACAAGGTATACATAATAAAATCAGATATAAGGAAACCAGCCAGTTCAATCAATGTTTT
TTACCTTGTACATCACTAATTAGTAAATATGTTCTCCTTTTTTTACAGGGAACTCCTTCAGTTCTTGCTTCAGATCAGAAGATTAATTCA
CTGGAGAATGCCCCAAGTCCCATCTCTGTCCTCGACACGTCATATTACCATACAAGACTGTCATATTCATTCAAAGGTGAGAAGTTG
ATACAGTATTTTTTCTGCATTAAGATAACCAACTGCAAGAACAGCAACATGATGGATTCTACTGTTTGCTCTCATTCAATCCAGAAGC
CCATAGTGTCATTCAAAGGACAAGCATAGTTAGCTGTAAGCGTGCCAATGACGCTAGTGACAGATAATCTGCAATAAAAGCTACAA
CCAGGTAGCTTGTGGTCCTGATATGGGGAGGAACCACAGCAGATGGACTGTTGCAGAGTTGCAGCTAGATGACCAGAACATTGTT
AGGTTATAGCAAGGCCCACATGTTGCACTTGCTTATGCAGGACAGCAGGAGCATGATGTGTGTCTTCTGGTGTATATGCATTGCTA
GTATAGACGTGCCCACCAATGTCCCCCTCTACAAATACACCTAGCATGAGTATGATTCAGTTGATCCGTAGACAGATAGTGATATCA
GATCTCCTGTCCAGTACATGTTTTTCTGCAGTTGTTAGGTCTGATAATGAATACCGTATTTCTGTCTGGTATATTACTATTTTCTGCAG
TTGTATTGAACACTGGTTTCTGAATACATGCATATCCTTTTCTGCTTGTTCAGATGGGGAGACACATTCTTCAGAGGAGTGCTGGAA
CCCGAACAGCCTGCCTGACACGCCACAGTCCAAGACGAGCAGTGAAGTCAGCCAGATCAAACCAGAAAATTTTGAGGCCCTCATCC
AGAAGCTTGAGCAATTGCAGTCAATGAATGATGAAGTTGCAAACAAGAAAGATCATCAGTACATTTACGAGATACTCTTAGCATCT
GGCCTCCTGCACAAAGAACTTAGCTTCGTAGCCATGCCTGGTCAAGCATGGCCATCAAGCTGCCTGATCAATCCAGAGCTCTTCCTC
ATTCTTGAACAAACAAAGCCAGATTTTGCTTCAGCAGACCAAACTGTTACCAAGAGCTCCAAAGCTAACACAGAAAAGCTTCATCGA
AGAATTGTATTCGATCTGGTAAACGAAATTACAGCTCAGAAGATGAACATTCATTGCTCGGCAAGTCAGTCAGCCAAGTCGCTTCA
ATTAAGGAAGTACAACGGATGGCGACTTTTTAAGGACCTGTGCACAGAGGTTGACAGGCTTCAATCTGAGAGTTCAGCGATAAAAT
GCTCTGAAGAGGATGGGGATGAAAGAATGCTATTGGTTGAGGATCCACTGAATGGAATAGAAGATTGGAGCTTCGATAGTGAATC
GCCAAGCACGGTTTTGGAGATCGAAAGATTAATCTACAAGGACCTCATTGACGAGGTCATATGGGATGAGGCCACAGGGAAGATG
CAAGGTGGACAGTGGAACCTAAAGAGGCAGCTGTCATTTAGTAGTACAAGCTGAATATGCTTGGCAATACATGTTTCCCCTAGGAA
GCTTAGCAACTACACTACACTAGTGAATGTAACATCTTGTATTTTGCTGAAGATTAAACTATAGAAGAAATATAAATATTCC

SEQ ID NO:3 protein OsGW7

MPPARVLGGGGGGGGLGDEAPELERQMGCMAGIFQJFDRRQRLLTARRRRPPPKMLPPGPGHTLPRSSSNVAAQSSSTSKIVLEKTFSK
SMTENSSLSIESSRASCSSSSCSSFSSLDGNKSIQQELPYINEQLFVQRPLKSSPSLKDPVMDTRSGQSNIGFRDIVKDSINRDTGGLTVKTSV
KDARRNGQYKDSPRPLLLSKSMDGTYVIGIDRSTKVPANAVESSRRFPEQSRFSCDDRRLLRPVEAQENKKPSTRLKELPRLSLDSRKETLSS

Fig.15 cont.

SSRQKTFSYRRTDDSLMDALRPQDSPGHRRASSVIAKLMGLEEAPNATGVLTVDSYEPERSPRPAEDTQKEHPVPSPRRFCQDPRESLPK
DESPAMKTKPSPRILTESAPWRQQEKIATSSKASQCRDAEVRPRTASLYAYIERRGGGLEFLECNKDFRALRILEALHAKDAKRQNDGNGA
LTVAAQQAGDALNTSSRHFQPPIVVMKPARSTEKQPGVSLASVDPLAGFRNLRKLQARDAPCIGEHETSTNEKVHSRISRAQSKSDEPAS
RASSPRPTGSSSPRTVQRKAESERRSRPPVSPKSPSKKSSEAASPGGRTRTKPSQGKNHRDNEVSKSPRSRISMVKEIDISIMDFQKPLAST
PSHKGTPSVLASDQKINSLENAPSPISVLDTSYYHTRLSYSFKDGETHSSEECWNPNSLPDTPQSKTSSEVSQIKPENFEALIQKLEQLQSMN
DEVANKKDHQYIYEILLASGLLHKELSFVAMPGQAWPSSCLINPELFLILEQTKPDFASADQTVTKSSKANTEKLHRRIVFDLVNEITAQKM
NIHCSASQSAKSLQLRKYNGWRLFKDLCTEVDRLQSESSAIKCSEEDGDERMLLVEDPLNGIEDWSFDSESPSTVLEIERLIYKDLIDEVIWD
EATGKMQGGQWNLKRQLSFSSTS

SEQ ID NO:4 promoter OsGW7

TATATCATACTTATATGGCATAGTTAACACCGGCAACAACAATAAGATGAGCTTGATCTTAATCTCTTCTCCTTTCAAGTGCACTAAA
GTCCAATGACCGTACTACGTGTTACTACCACATTCACATAGCTAGCTGTGCCCTCATAATTGTGCTGTCCAACGTACTGGTACTACTA
CACGGTTTGGAAAACCAGTCCGTTCCAAACCAAACATCTCCAAGATCCGTTCTCTTTTCGGCTAACCAGTAGCAGCAGCAGCAGCAG
ATCGAGCCTTAATTCAACTAGAACCAACCTGCAAGATCCAAAAAAAAAAAAAAACAACTGATGCAGCAGTAATAAAAGAGATCACAC
ATTCACAGTGGCTTTGGTTGCATCTTTTGCATTGGTGATCACCATTTGGAGTGACCACACACACTGCAGATGCATGAACTCCATCAT
GGCGAGGTGTTTTTACTGCTGCTGCCCCTACACGAGGAATCTATCCGTCAGATCAGATGGGCCTCTGGGTAAAAATTTTAGCTATG
GTGGTAGTAGTAGGAGCGAGTAGGCATTTTCACGAGCATGTGGTGTGCACGAGAGAAAGCGAGTGAGTGAGTGAGAGCGTGTGC
GTAGTGGCAATGTCACACGAATCGCTGTGCATCTCGCGTATGATGAGACGCGACGCGGCTGTCGCTGGCGCACGCGTTAACCTCG
GACTCTCCTGGCAACGATCGACATCCGGGGTGGGCGTTCACCTTTCCGATTGAATGTCCGATCCCTAACCTCTGGCGGTACGATGGT
TTTCGTCGAATTCCGACCATTTTTTTTCTTTGAAATTTGAATGTCTAGGAGCCATTCGGAGTTTTACTCGGAGTCTGCTTTTGTTCCGT
GTCGAAACCAAAGAAATTTTGCGGTCTTCGATCGATCTTCATCGGAAAAACCGTCTCCGTAACGCGGCGCGGTGCGAGGTGAGTCA
CATACTCCATCACCGTTTCATATTATACGTCGTTTAACTTTTTCTCTTAGTCAAAATTCTTCTAAGTTTGACTAAATTTATAGAAAAAAA
TAGCAATATCTATAACACGACATTAGTTTCATTAAATTTAGTATTGAATATATTTTGATACAATACTTGTTTTCTACTGGAAATGTTAC
TATATTTTTAATAAACTTAAATAACTTTTCCTAAAAGTCAGACGAATTATGATATGAAACGGAAGAAGTATCTAGCAAATTACTACTC
TCTCTGTCCCTCTCTAAATTCATAGAATTATGACGTGTCACATCTACGTACGGAGGGAATAAAACGTAAGTGAGGTGTTTGAATCTT
CTTAAGATGAAGATGAAGATAAAGATTAAGTGTTCCACGCAAAACGAGGTGGTAATAACGTGTGATTAATTAGGTTTTACTTATTA
CAAACTTGAATAATGGATTAATCTGATATTAATATCAGAGCAACTTTCATACACCAAAAACGCCGTTTAGCTATCCAAAATGTTGGA
GAAACGAACGCAGCAGCCAGAACGTAATCCAAAGCCGTCAAGAGGAACCTAATCGAAACCATATACCCCCGTTGCGGCAGCGGGT
TGGACAATATGGTATTGTGGCCGTGGTAGGGAGAGGTGGTGGTGCGCGCGCGGTCACATGCCCAACCCCGCAACAATGATCGAA
GCCCCCCCTCACATGCGTGGCCGGCTCGCGTCGCGGGCAGCAGCATTCGGCCGTGGGTGCCGGGAGCTGGACATGGACCATCGAC
ACGCCTTGACCCACACCCCCCCACCCCACCAATCCCCATCCCTCCCGCTTATTTCAACCCCCCCTCTCCCTCTCCTCACGACACCCTG
CATGGCATTCGCACGCCATTGACACATATCTCATCATACCATCACCATACCACATCTCATCTCACGCGTCCCAAGTGTACGTACCTCT
GCTTGCTCCTTGGCTTTCTGAGCTGAGCTGCTCTGCAGTTGGATGTGCGTGAGCTGGTGATCTGGGAGGAGTCGGAGTCGGAGGG
GGAG

SEQ ID NO:5 cDNA OsGS3

ATGGCAATGGCGGCGGCGCCCCGGCCCAAGTCGCCGCCGGCGCCGCCCGACCCATGCGGCCGCCACCGCCTCCAGCTCGCCGTCG
ACGCGCTCCACCGCGAGATCGGATTCCTCGAGGGTGAAATAAATTCAATCGAAGGGATCCACGCTGCCTCCAGATGCTGCAGAGA
GGTTGACGAATTCATCGGAAGAACTCCTGATCCATTCATAACGATTTCATCGGAGAAGCGAAGTCATGATCATTCTCACCACTTCTT
GAAGAAGTTTCGCTGTTTGTGCAGAGCAAGTGCGTGCTGCCTCAGCTACCTCTCCTGGATCTGCTGCTGCAGCAGCGCCGCCGGCG
GCTGCTCATCCTCCTCCTCCTCCTTCAACCTCAAGAGGCCGAGCTGCTGCTGCAACTGCAACTGCAACTGCTGCTCCTCCTCCTCC
TCCTCATGTGGGGCGGCGTTAACGAAGAGTCCGTGTCGCTGCCGCCGCCGCAGCTGCTGCTGCCGTCGCTGCTGCTGCGGCGGCG
TCGGCGTCCGCGCGTGCGCGAGCTGCAGCTGCTCCCCGCCGTGCGCGTGCTGCGCGCCGCCGTGCGCGGGATGCTCGTGCCGCTG
CACCTGCCCGTGCCCGTGCCCCGGCGGCTGCTCCTGCGCGTGCCCGGCGTGCAGGTGCTGCTGCGGCGTCCCTCGTTGCTGCCCCC
CCTGCTTGTGA

SEQ ID NO:6 gDNA OsGS3

GATCATCTCCATTATCGGAACTTCGGAGTGACATGGCAATGGCGGCGGCGCCCCGGCCCAAGTCGCCGCCGGCGCCGCCCGACCC
ATGCGGCCGCCACCGCCTCCAGCTCGCCGTCGACGCGCTCCACCGCGAGATCGGATTCCTCGAGGTACAATCTATCTCTATCTGTCT
ATATCACTACCATTCATACTCCTTCGATCTTGCTTCAAAACAAAAAAATATATATTTCCTACTTCATATTCATATACACACGTACGGCT
TGCTATCTGTCGAATTGTTTGCTTCTGCATGCATGCATCACTCTCATTGTAAGTTTTCCCAGCTTAAAACCACTCCTTTTATCTTCGTT

Fig.15 cont.

```
CTTCTTCCTTCTTGTTTTTTTTAAAAAAACAACAACTCATTTAATCTTCATATAGTGTATCATGCATCATTTGCTTCTTTGATCAGTTCC
CCAAAAACTGCTCCTCTCTTCCCAGCCAAATAATTAAACTTAAGCAAACAAGCAAGTTGAACTGATGATCCAATAAAACAAAACAAA
ACCGATCGAATAGGAAGTCAATGGCATATACCAGCTGCTATAGCTGAAGCCACGAATGCTTAGCTTAGCTCTAGTCGATCCCTGTTG
ACTGTTCAACACACTGCACTAACACACCAGTTAATGAGCTGATTAATTAAACCATTAAATGAGCTTAACGGGCGGCTAGCTTCTTCC
TCTGGGCCCGTGCCGATCGTACCATCGGTTTGCGCGTCCCTCCACCTAAACTCTCTGCCTTGTTATTCCCTTTGCCTAGTACTACATGC
ATTTGCATCATCATCCCATCACCAATAGTACTACGTTTCAACTGGATTTTGGTGGTGTCCAACCATATCATATTTGGTTTTGTTCTCTA
GTTTACTCCTACATTAGTCTCTAGCGGTTTTGTGGAGTACTAAAGAAAACAACTAATCAGCCAGGGTTTAACGTTTAATCGGTTGGT
GGTTTTGTTAATTAATTTCATCTACTATTTTAGACTTCACAGGTCTTCGAGCTATAAGCATCGATTGCCATGCATCAATCGATGCTGG
TCCACGCTAGTTTCTGAGTTCTGACTAGCTCTCTTAATTGTGCTTTGACCTACTTTAATTAATTAACCAGTGGCTGCGTCACTCATTGA
CCAACATTGTCATGTTACCCGGACTGATTTTTTTTTCTTTAAAAAAACACCGGATATATTATTAGTTAGTGTATATATATGTCTGCTC
AAGAAGCGCATGCATATAGTTTCTCGTCAAACAAAAAATGTACTGTATGCTCAAAGCATCTGTTTTGGAATTGTCATATTCGCCTTTA
TAATTAAAATAATTAAAATGGTGATGCCCAGCTTTTTTTTTCCTCCAATAATTTATTTATTGGCTTGATTTCCTGTGCTATTAGGAGTA
AAACTACTCCGTTTTAATTAGCACCATTTTTAAAGCTTCTAAAATTAACCTAAGTAAAGTACGACAGTACTTGCTGTCTAGCTTTAAAT
GTTTTGGGTGTTAAAATATCCCTCAGACATCACCTGAAAAGTTGACAGGCTAAACACATGCCCATCTCCCTCGTTTACTTAAATTAAT
TCGAACAAACAACTGTATATATATTTCTTGCAGGGTGAAATAAATTCAATCGAAGGGATCCACGCTGCCTCCAGATGCTGCAGAGA
GTAAGCCAGCCTGCTGTTTCTTTTTGTACTACTTCCATTTCTTCTCGTCTTACTCTTACCATGCATTCACAAAATATACTTACTTACCC
CAGTTTTTGATCATGAACTTTGACCGTTATCTTTTTAAGCAACTTCAATAAAATAGGTTTAAATGCAAATGTTATGTACACCATTGATT
ATAAAACCTTGGCAAATGAAAGTAAAAAACCAGCACATTTAATTTCTGAACGTTGGGAGTATTATTATTTTTATATCTTTTACTATCA
TTTAATCATAGTATCGTGCAAGCTTTTTGAGTGTAATTAGGTTGCTTAAGGTAAAAAAATGTAACTAGGTTACATTTAGTACTAAACT
GAACATTTAATTAGTAATGTTTCGTTAAGTAACTGTAATTTCAATGCATGCATGTCCTCCCGTAAGAGCAAGTTTAATAGTATAGCCA
ACTACTAGCTCCAATTTATTTATAGACAATCTAATAGCTCATTCATACAATAATTACATACTACACTATTAATATCTGATCCCACCTGT
CATACACATACTGCATTTTGGAGTCCGTGCTATAGCTGACTACAAATCTATAGTCCGCTGCTCTTCTCTCTCTTTATTTATCTCCTTAA
AATATGTTTGCAGCTGGCTTATAGCCTGCTATTGTACCTGCTCTGAAAATAGTGCAGAGACTGTTCAAAAAGTCATTGCACAATAAC
TATTCACATGGAACTGTGAAAAGTATATATTGGAACTTACTAGCTAGATCCTTTTGGGAACATGGGAAAAGCCAAGTCACGTGTGG
AATCCCTATTCCCTGTGTTCTTCAGCTAGAAGAGTGAAAATAATGTACTACTACTATACGGAGATGAAATTACAGCAGGAGCAGAA
AGCGGGAAAAAAACTTTAAATCAATTAAACAAACCTCTCTCTGCAAAATTCAACACCAGCAACGAACAACTCATCAAGTTCTTGTGT
TATGTACCGGCCGGTAACTAATTGTTGTTTGCATAAGCGAAACGGTATATTTGCAAACAAAAAATAATTTATGAATAAAACTTTTAT
ATACATGTTCTTAATTATCTCAAAACAAAGGTTGAAAAATAAACTTCGATGAAAAAATCTCAAATCAATTCCAAATTTATGGTGAA
AATTTTAAATTTTGTCTGATAAACATAAGTATAAGCAAAAAAAAAGTAAAGCAATGTCACTATGTTAATGGTATTGGTATATATAC
CTTTGAGTTTCTGTCTGTACTTTAGGAGTACATGCTACGAACATGTTTTCTTGGCTTCTATTTCGTTGGAATTACTTGCGTATTGTGGG
CCAGACGCCTGGTGAACTTCGTCGATTGTGTGGACTAATTAAGCTCACCTGAAATAAGTGGTTGAAAACAAGGCTAAAGATGATTT
TAATCATGGATTTTGGCTTGGAAATTTTTTTGTAGGGTTGACGAATTCATCGGAAGAACTCCTGATCCATTCATAACGATGTATGGA
TTTTCAGGTCGAGAATTTGTCTTTAACTTCGCACGACTGTTATTTTTTTCTTATTAATTCTCTGTTTACAAGCAGTTCATCGGAGAAG
CGAAGTCATGATCATTCTCACCACTTCTTGAAGAAGTTTCGGTACTCACTTCATTCCCGGATCTTAATGTATATATGCATATCTGCACT
GTGCTAATTGGTGTACACATTATGTGATCATCAGTCCAAGTTAATTATTACTTACAAAACTGAACTAATAAACACTAGAAAATATGTA
ACTTGCAAAGTACATATTGAATCAGGGATTCATATATAGAACTCCACCTGCAGATTTCTTCCAATATATATATGCTGTCACCATGTTT
TCACTTGTCACCTAGTACACCTTTGACTGGGAGACTTTCCTTGATGATCGACGTGGTCATATTCTTCAGATTGATTTAATTTCAGATA
GAAAAAAATATTGTTTACTTAGTTTCTCTCCTTCAGTAAGAGAGATGTGCAAGACCAGCGATCAAACTATATGAACTGTTCGTTTCAT
GATAAAAAAAACATGATATGGAATAACTAGGTGATTCAACATATAATGGCTGATAATCCCTCGTTTCAGGAGATACCATCAGTTTTC
TACTTTTCTACTTTTCTCCATGTTCTCTTTTTCATGTTTGAGGTGGATCGGAGCTTGTATTAGATGTTTGCTCAGCTCAATTATTGCTGC
AGATTTCCCTATATAGCCTCCACTGTATATATACTCCCTCCGATTCCATAATTTAATGATATTTTGAACAATGACGCTGTCTCCAAAAT
ATATCTTTCACTTTGTTTTCCTATTATAATATATACAATAAAAAAAATACATATTTACTTTTCTTATAAATAGTTTCAAAGACAAATCTA
TATATGTTGTTATATAACTCTTTTAAACTAAATATTTTTAAAGTTATAGTCAAAGTTACAAAAGTTGGACCTCAAACATGTATAAAAC
GTCGAGAATTGTATATCTGATCAACCAATAATTTGTAGTGCATTGTCTTAAAAAAATTGCATTTCTAGCTATGTATCTAGATAATTAC
AAGAACCAGGTGAAATCACATTTTATTTTTACTGGACCACGAACTCATTGTTTAATTACTTCCAGCCTTGCACTAAATAACAATAATT
GAACCTGGCATCACCTGCACAATTAATTTGGACACAAAGTAAACATGAATGCAACATACTTCGTTTCATATTGTTTGTTGGTGTAGG
ATTTAAATTTTGTGTCAAAATACTTGCCGTTCTTACTACATTCTTAAGCACTTTGAGAACTAACCTTCTCTTCCTACCCTTCATCAATAC
AGTCATACTAACTAATTGGCTCTTATGCCTTGAAAAACTAATTAGGATGTATTTAATGAGGGTAACCATGTAATCTGCCACCAGTGA
ATGCAATTTTGGTTCAAAATTTCGGGCCCCCGCCCTAAAAAGTCATTATCTCGATAGAATTTTTTTGAATTTAGTCAAAATTTATTCAA
ATTTAGCCAAATTGTGTTAAATTTCAAATAATTTCAGTCTAAAAAGTGCTGAAAATCCCGAAATTTAGGTTCTACCGAAATGGCCGG
AAATTTTCAGCGAAAATCAAACATGAAAACCTTGTCTGCCACATTTGTTAGTTTGTGTAAAGATTTGCTAGAACGATAAGTAATTTG
AAGCGGATGTATATTATATATCCCACAAAACCATCAACTTGTTAATTACATGTATATTTGTGCATGATGCTTTCACCACTTTGTGGTT
GTTAACGATTAAATCACACGTTTTATTTTCTCACAGCTGTTTGTGCAGAGCAAGTGCGTGCTGCCTCAGCTACCTCTCCTGGATCTGC
TGCTGCAGCAGCGCCGCCGGCGGCTGCTCATCCTCCTCCTCCTCCTTCAACCTCAAGAGGCCGAGCTGCTGCTGCAACTGCAAC
TGCAACTGCTGCTCCTCCTCCTCCTCCTCATGTGGGGCGGCGTTAACGAAGAGTCCGTGTCGCTGCCGCCGCCGCAGCTGCTGCTGC
```

Fig.15 cont.

CGTCGCTGCTGCTGCGGCGGCGTCGGCGTCCGCGCGTGCGCGAGCTGCAGCTGCTCCCCGCCGTGCGCGTGCTGCGCGCCGCCGT
GCGCGGGATGCTCGTGCCGCTGCACCTGCCCGTGCCCGTGCCCCGGCGGCTGCTCCTGCGCGTGCCCGGCGTGCAGGTGCTGCTG
CGGCGTCCCTCGTTGCTGCCCCCCCTGCTTGTGATCGATCGATCGATTGAGCGAAGCTGCACTGATTGGTTAATTAATTAGTTCTCG
ATGATGATCGATCGAGCTGCGCGCGTACTTAATTAGCTAGCTAGGTTCTGGTGTTAATTAGTTCCTCATCGATGCATATGTTGATTG
CCTTGCTCTGCTTGCGGTTATCTGTAATTTGGCTTTGCTGCCATGATGAGTACGTGATTGCTGATTTATTTTAC

SEQ ID NO:7 protein OsGS3

MAMAAAPRPKSPPAPPDPCGRHRLQLAVDALHREIGFLEGEINSIEGIHAASRCCREVDEFIGRTPDPFITISSEKRSHDHSHHFLKKFRCLC
RASACCLSYLSWICCCSSAAGGCSSSSSSSFNLKRPSCCCNCNCNCCSSSSSSCGAALTKSPCRCRRRSCCCRRCCCGGVGVRACASCSCSP
PCACCAPPCAGCSCRCTCPCPCPGGCSCACPACRCCCGVPRCCPPCL

SEQ ID NO:8 promoter OsGS3

AAGAGTGAGTGTGTGTATAATATGATAGGGTGTGTGTGTGTTTTTATAAGAACGACTACGCGCATCTCTATATTTCGGTACATCCCG
GGTATGCCTTCTCTAAAAATGTCTTGTGCTAAAGTTGAAGACAACTTCTAAGGAAGGTATCTCTCATCTTCCTTGTGTGTCCCTACTA
GAAAATATTTTTACAGGCGGCCAAAATATTTTTTTTTGCAGGCGTCCATAACCTCCGCCTACACCCAAAGTCATGCAAAAATCAATAA
TTTTTGTAGGTGGCTAAATCCACCCGTTTGCGAAAATATTTTCAGCGTAAAGAAAATTCGCCGCCCTCAGCCCTACCCACCGCCGCCC
TCCCCTTCGGCCGGATCTAGGGTTATGGTTTTGGGAGGAAGAGGGAGGGGAGGGGAGCTGCGTCACCATCACTGAATCTGGTAG
GTGAGAGCGCCGCCATGAGCTCACCGGTGCTGCCGCCGACCTCCTGCCTACGTGCCGCCTTCTCCGCTGCAAGTCGCCGCTGCTGC
CCTCCCCACGACACAGCTGGATCCGGGAGGGGAGGGCAGGGAAGGTTCGCTGTCGCCGCCGCCACCCTCCCTACGACGTAGCCAG
ATATGGGTGGAGAGGTAAGCGCCGCCGCCGCTGCACAACCCACGATGCCGCCGCTGCACAACCCGCGATGCCGTCGGCCGGATTT
GGGAGGTGGAGCGTCGCCGCCCTCCGCCCCGCGCCATGTCTGAGGAAAGAGAGCGATGGGAGCGCCGCCGGCCACCACCGTCCC
CCCTTCCCCCTCCAACCAGATCTGGGAGGAAGGGAGGGAGGGAGGGGAGCCATCACGTCGTTGGGAGTAGATGCCGCCACCGCC
CTCCCCCTCCCTGCGGCCACCACACTGGGGTGCACCGCCACCGCTAGGTAGCCGCCTCTGGCTGGATCCACGCCGAGGAGAGGAA
GGAGAGGGAGAGGGAGAGGGAGGGAGGGGAGATGTGGAAGTTGACTTAGAAAATTTTGACGCCCGGTGGTTTTTAAGATACT
TTACCTTTTTGCAGGCGGATTTATTAAAGAGGTCCGTCTGCAAAAATAATGATATTTTCACGGTCGGACCTCTTAAGATATCTACATG
TAGAAATCTATATTTTTTTACTTAAATTACTGCCAGGGCTTTGCCTCGTAGTATAATTTTCATAAAAACTCAAAATATTTACAAATTAC
AAAAGAGGAAGGAAGGAGAAAAACTTATAAAGATTACAATGTTTGTAACCAATCAAAAACTATCTGCTTTAAAGGATCTTTCATTCT
ACACATATGAAGAAGAACTTCTTTTCTAAACGATATTCTTCATGAACCAAAGGAGGGAAGCTCATTCCGAAAATTTTTCCCATTTCTC
TGCTCGTAGGCGGATAACTATCTCATCTCACGGTTGTTATTTTTGTAGGTGGCTATTTGGCTTCCAGAGACCTACTCGTCCGGGAAA
AAGAAATGCCAGCATCTAGAAAAATAGTTTTTCTAGTAGAGTGTTGTGAGCGTCTGCGATCGTGGTAAAGAAAGCAAAAAAGGTG
AAGGACGAGTGGCATGATACATATGGGAAAGCTGTAGACTTTGACCCTTGACTACTCGTTGGAAGTGTGCGTCTGCATGCATTATT
GAACGGCTCTGATCCCCGCGGCGCAGCGGATCGGGTCATGTCCGGATGGGCATATCGACGAGAAGGATCCGTCCCCGACAATCT
TTCAAGGCCCGTGCCCCGTCCCTCCTCTCCTCTGCGCCTTTCCATCATCATTTACGCCCAACCCCAACACATGTACATTTCCCTTGGC
TTGCTTCCGGAGAAGAAAAGAGCGGCCATCCACTCCACTCTCCACTCTCTCCCTTCCATCATTACTTGCCCAAAAACGGCAATCCCCT
CCCCTCCATCTCCATGTGCTCTTCCACCTAGCTCCGCCATTCAAAGCAAAGCACCAAGCTTTTGCCTCTCCCTCTACCATGCCTGCCCC
CTATACATAGCTGCTGCACCGTCTCTCTTCATAAATATACTAGTAGGAGTAGCAGAGCTCATCACTTCGATCATCTCCATTATCGGAA
CTTCGGAGTGAC

RICE PLANTS WITH ALTERED SEED PHENOTYPE AND QUALITY

This application is the U.S. National phase application corresponding to PCT/GB2016/050247 which was assigned an international filing date of Feb. 3, 2016 and associated with publication WO 2016/124920 A1 and which claims priority to PCT/CN2015/072156 filed on Feb. 3, 2015, the disclosures of which are expressly incorporated herein by reference.

FIELD OF THE INVENTION

The invention relates to plants with improved agricultural traits, in particular rice plants with improved grain quality and related methods.

INTRODUCTION

Rice is the key source of dietary calories for over half the world's population, and a substantial improvement of yield potential will be required to feed a growing human population. Over the past 50 years, the two most significant genetic contributions to its productivity have been the increased harvest index (the ratio of the plant's aerial biomass which is represented by grain) achieved by deploying semi-dwarfness[1], and the exploitation of heterosis[3,4]. However, improvement in grain quality still remains a major problem[5], since this trait is a complex trait determined by appearance, cooking and eating quality etc., all of which is controlled by quantitative trait loci (QTL) and influenced by environmental changes. Despite much research effort[6-10], to date only a small number of relevant genes have been identified[11-13]. The deployment of heterosis in the form of hybrid rice varieties has boosted grain yield, but grain quality improvement still remains a challenge.

The invention is aimed at addressing the need for improved grain quality and increased yield and provides plants with improved grain quality/yield and related methods and compositions.

SUMMARY OF THE INVENTION

The inventors have shown that a rice grain quality quantitative trait locus qGW7 reflects allelic variation for GW7, a gene encoding a TONNEAU1-recruiting motif protein with similarity to C-terminal motifs of human centrosomal protein CAP350. The up-regulation of GW7 is correlated with the production of more slender grains as a result of increased cell division in the longitudinal direction and decreased cell division in the transverse direction. OsSPL16/GW8, a SBP-domain transcription factor which regulates grain width, binds directly to the GW7 promoter and represses its expression. The presence of a semidominant GW7$^{TFA}$ allele from tropical japonica rice was associated with higher grain quality without yield penalty imposed by the Basmati gw8 allele. The inventors have shown that combining up-regulation of GW7 with downregulation of GS3 results in an increase in grain quality and yield.

Thus, in a first aspect, the invention relates to a plant wherein the expression of a nucleic acid sequence encoding a GW7 polypeptide or the activity of a GW7 polypeptide is increased. In one embodiment, said plant does not produce a functional GS3 polypeptide.

Thus, in another aspect, the invention relates to a plant wherein the expression of a nucleic acid sequence encoding a GW7 polypeptide or the activity of a GW7 polypeptide is increased and wherein the expression of a nucleic acid sequence encoding a GS3 polypeptide or the activity of a GS3 polypeptide is reduced or abolished.

Thus, in another aspect, the invention relates to a product derived from a plant as defined above.

Thus, in another aspect, the invention relates to an isolated nucleic acid comprising a OsGW7 nucleic acid sequence comprising or consisting of SEQ ID NO: 1 or 2.

Thus, in another aspect, the invention relates to a vector comprising an isolated nucleic acid comprising a OsGW7 nucleic acid sequence comprising or consisting of SEQ ID NO: 1 or 2.

In another aspect, the invention relates to a host cell comprising an isolated nucleic acid a vector as above.

In another aspect, the invention relates to a use of a nucleic acid comprising or consisting of SEQ ID NO: 1 or 2, a homolog or functional variant thereof or a vector according to 31 in altering the phenotype of a leaf, seed, grain or another plant organ.

In another aspect, the invention relates to a method for altering the phenotype of a plant organ said method comprising increasing the expression of a nucleic acid sequence encoding a GW7 polypeptide or increasing the activity of a GW7 polypeptide. In another aspect, the invention relates to a method for producing a genetically engineered plant said method comprising increasing the expression of a nucleic acid sequence comprising or consisting of SEQ ID NO: 1 or 2 or a functional rice variant thereof or increasing the activity of a GW7 polypeptide comprising or consisting of SEQ ID NO: 3, a homolog or a functional rice variant thereof or comprising introducing a mutation in the promoter or coding region of a GW7 nucleic acid sequence comprising or consisting of SEQ ID. No 1 or 2, a homolog or functional variant thereof.

In another aspect, the invention relates to a method for identifying and/or selecting a rice plant of a rice germplasm that has a phenotype selected from increased length of grain or other organs and increased slenderness grain or other organs, comprising detecting in the first rice plant or the rice germplasm at least one polymorphism within a marker locus that is associated with said phenotype of said rice plant or said rice germplasm, wherein said marker locus is genetically linked with a chromosomal region comprising nucleic acid sequence SEQ ID NO:1, and wherein the rice plant or a progeny thereof or the first rice germplasm or a progeny thereof is selected.

In another aspect, the invention relates to a

In another aspect, the invention relates to a method of identifying alleles in rice plants or rice germplasm that are associated with improved grain quality and/or increased yield, the method comprising:
a. obtaining a population of rice plants, wherein one or more plants exhibit improved grain quality;
b. evaluating allelic variations with respect to the polynucleotide sequence encoding a protein comprising a polypeptide comprising: SEQ ID NO: 3 or in the genomic region that regulates the expression of the polynucleotide encoding the protein;
c. obtaining phenotypic values of improved grain quality for a plurality of rice plants in the population;
d. associating the allelic variations in the genomic region associated with the polynucleotide with the phenotype; and
e. identifying the alleles that are associated with improved grain quality.

In another aspect, the invention relates to a plant identified, produced and/or selected by a method as above.

In another aspect, the invention relates to a recombined DNA segment comprising a 5' UTR GW7 allele from rice which comprises a mutation that increases expression of GW7.

In another aspect, the invention relates to a rice plant comprising a GW7 allele wherein said allele confers increased grain length and increased grain slenderness.

In another aspect, the invention relates to an isolated nucleic acid selected from a nucleic acid comprising SEQ ID NO:119, 120, 121 or 122.

FIGURES

The invention is further described in the following non-limiting figures.

FIG. 1. Positional cloning of qGW7. (a) Grains from parents of indica hybrid rice. Scale bar: 2 mm. (b) Grain chalkiness of the two hybrid combinations (ZS97A/MH63 and TFA/MH63). (c) QTL locations for grain width and grain length. (d) qGW7 was mapped to a ~20 kbp genomic DNA region between markers M1 and M10 using 4,500 BC3F2 plants. The numbers below the line indicate the number of recombinants between qGW7 and the molecular markers shown. (e) The genotyping of progeny homozygous for qGW7 delimited the locus to a ~2.6 kbp stretch flanked by S5 and S6. Grain width of recombinant BC4F3 plants (L1-L4) and the parental plant. Filled and open bars represent chromosomal segments homozygous for, respectively, TFA and HJX74 alleles. Data shown as mean±s.e.m (n=60). (f) Allelic variation in the promoter region of the candidate gene LOC_Os07g41200 between TFA and HJX74.

Figure 2:
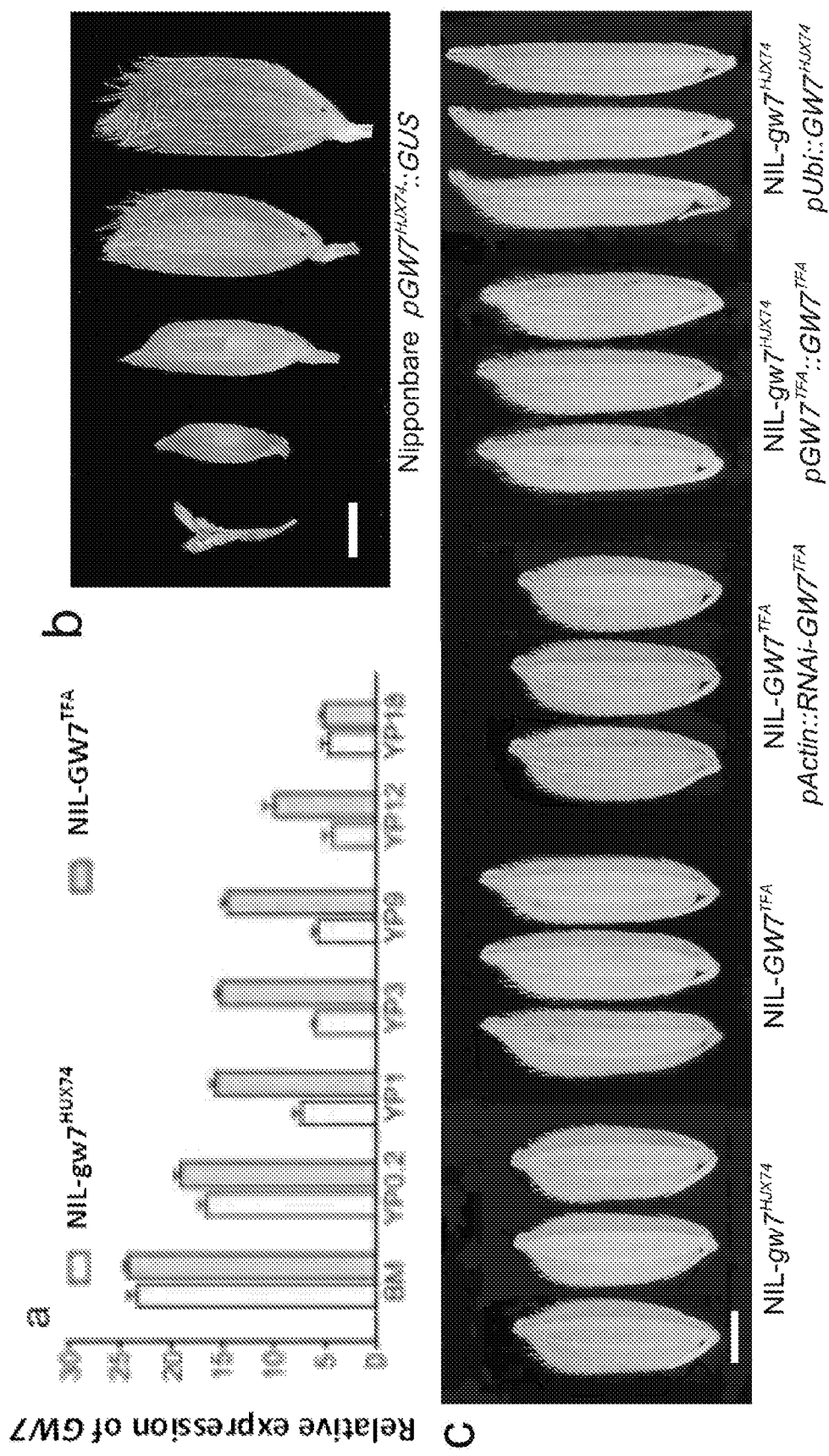
Figure 2:
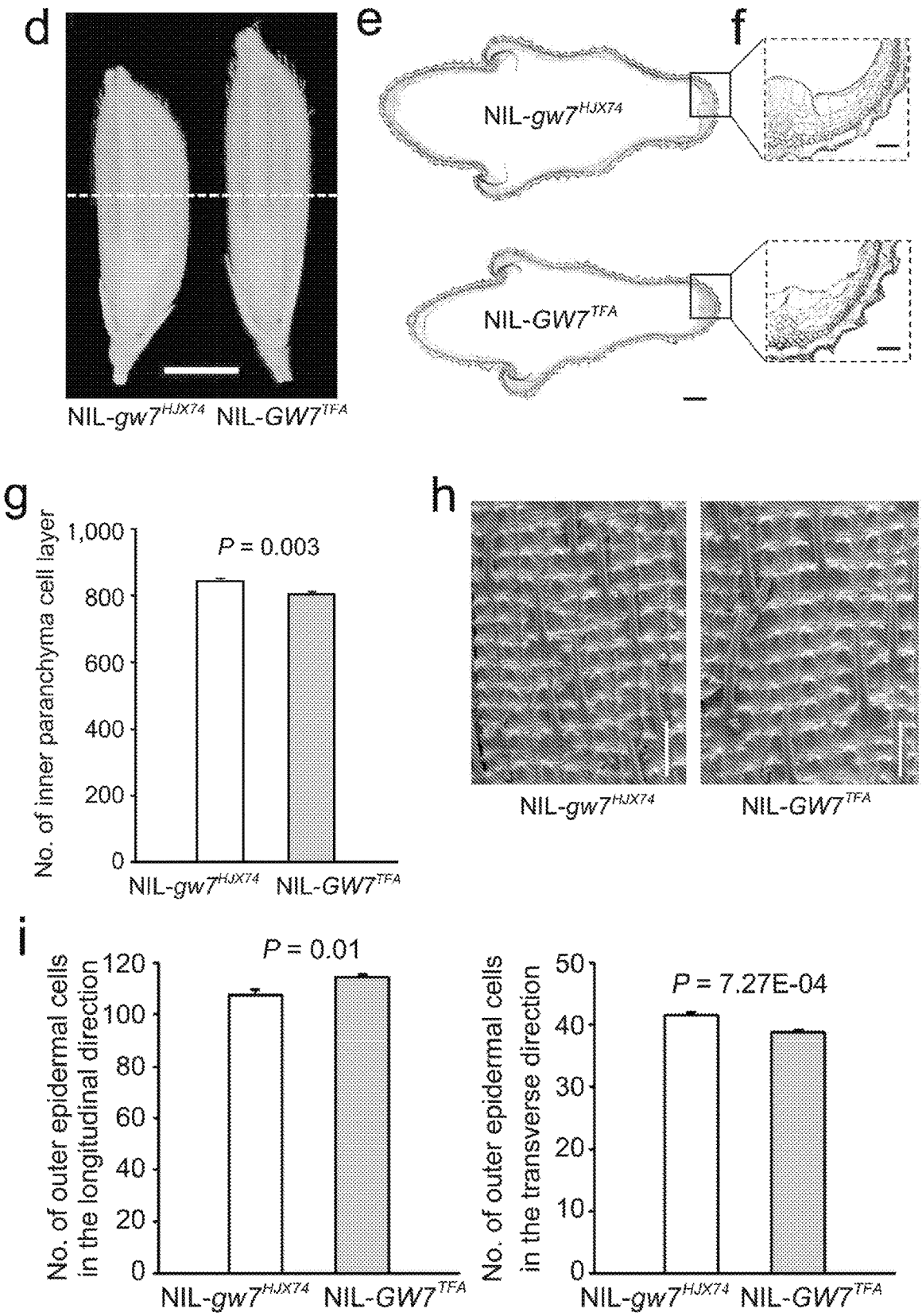
Figure 2:
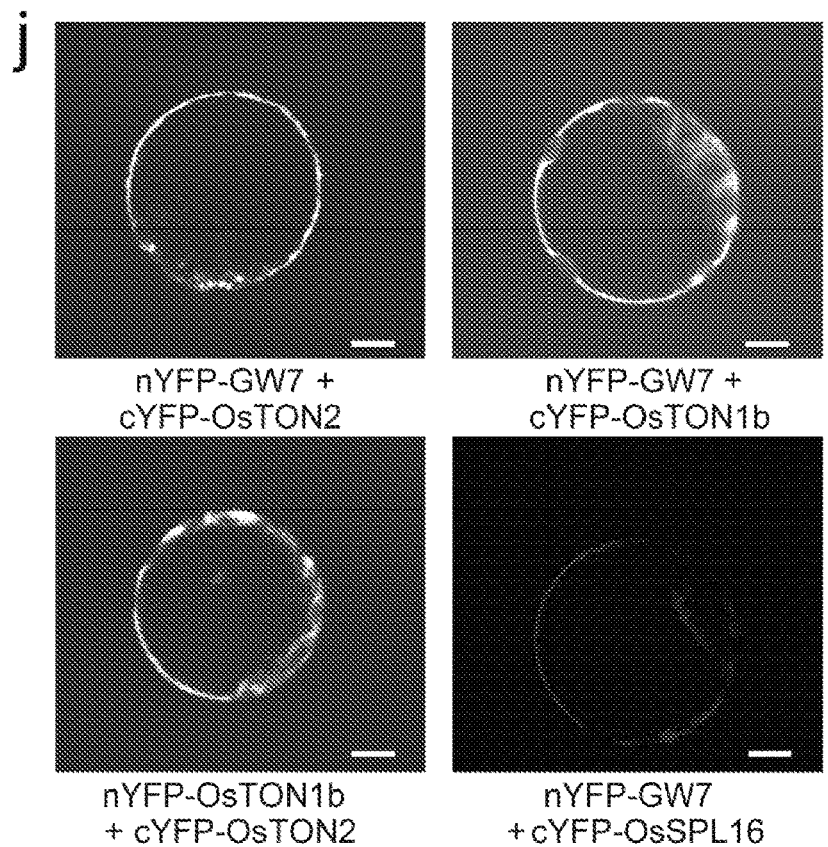
Figure 2:
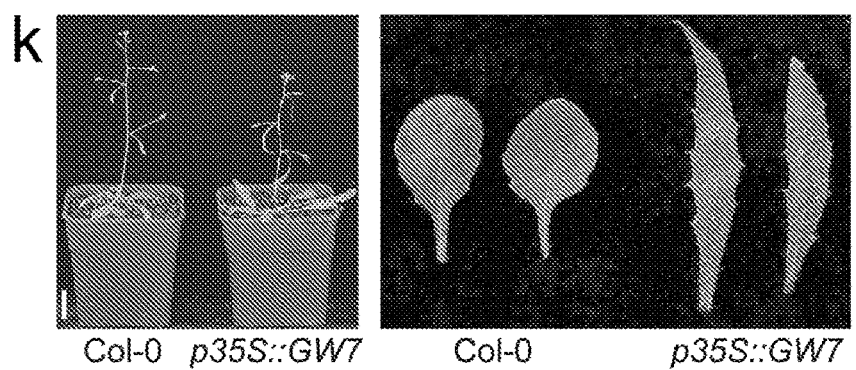
Figure 2:
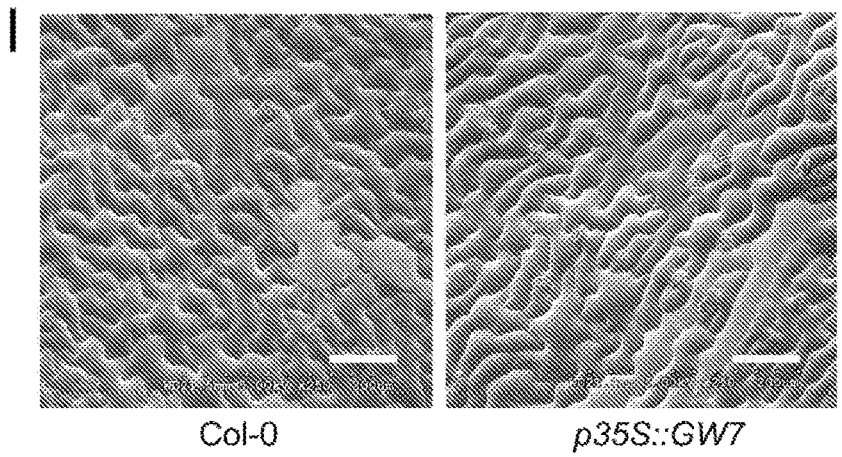

FIG. 2. GW7 regulates grain shape by changing cell division patterns. (a) Comparison of GW7 transcription between NIL-GW7TFA and NIL-gw7$^{HJX74}$ plants in developing panicles. BM: branch meristem, YP0.2-YP18: young panicles. YP0.2, YP1, P3, P9, P12 and P18 represent young panicles of average length 0.2 cm, 1 cm, 3 cm, 9 cm, 12 cm and 18 cm, respectively. Relative expression levels are expressed as the relative copies per 1,000 copies of rice actin3. Data shown as mean±s.e.m (n=3). (b) GUS staining. Scale bar: 2 mm. (c) Grain size and shape in transgenic NIL-gw7$^{HJX74}$ and NIL-GW7TFA plants. Scale bar: 2 mm. (d) The spikelet hulls of NIL-gw7$^{HJX74}$ and NIL-GW7TFA plants before anthesis. Scale bar: 2 mm. The dotted line indicates site of the cross-sections. (e) Cross-sections of the spikelet hulls. Scale bar: 0.2 mm. (f) Close-up view of the cross-section shown boxed in e. Scale bar: 50 µm. (g) The number of the inner parenchyma cells of NIL-gw7$^{HJX74}$ and NIL-GW7TFA spikelet hulls shown in e and f. An arrow indicates layer of the inner parenchyma cells numbered. Data shown as mean±s.e.m (n=10). A Student's t-test was used to generate the P values. (h) Scanning electron microscope analysis of the outer epidermal cells of NIL-gw7$^{HJX74}$ and NIL-GW7TFA lemmas. Scale bar: 200 µm. (i) Comparison of average numbers of outer epidermal cells in the longitudinal direction and in the transverse direction between NIL-GW7TFA and NIL-gw7$^{HJX74}$ spikelet hulls. Data shown as mean±s.e.m (n=30). A Student's t-test was used to generate the P values. (j) GW7 interacts with both OsTON1b and OsTON2. nYFP-tagged GW7 was co-transformed with either cYFP-OsTON1b or cYFP-OsTON2 into Arabidopsis protoplasts. OsSPL16 as the negative control. Scale bar: 10 µm. (k) Over-expression of GW7 produced long and narrow leaf blades in transgenic Arabidopsis plants. (l) The up-regulation of GW7 caused increases in longitudinal polar cell elongation shown in i. Scale bar: 60 µm.

Figure 3:
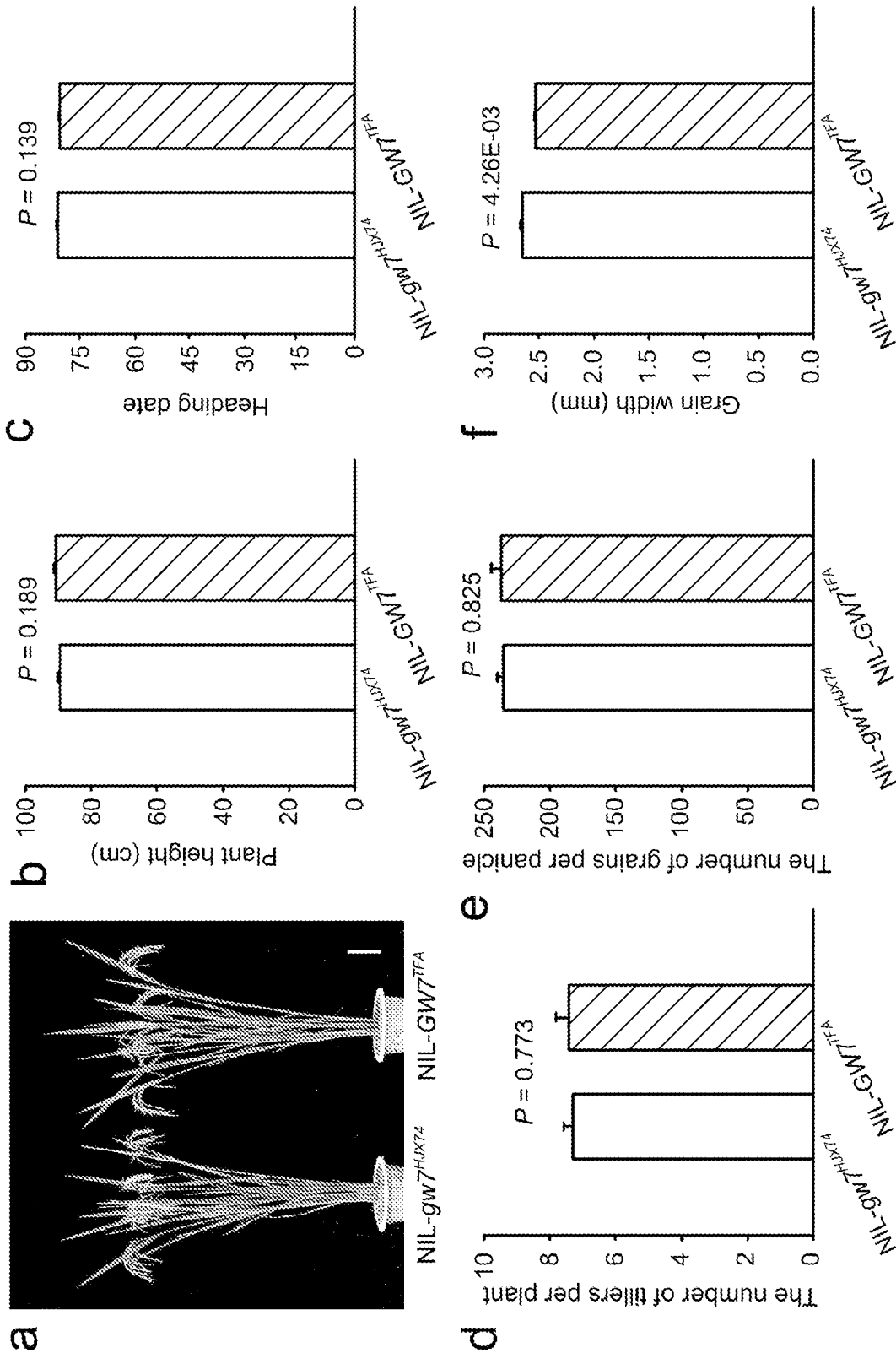
Figure 3:
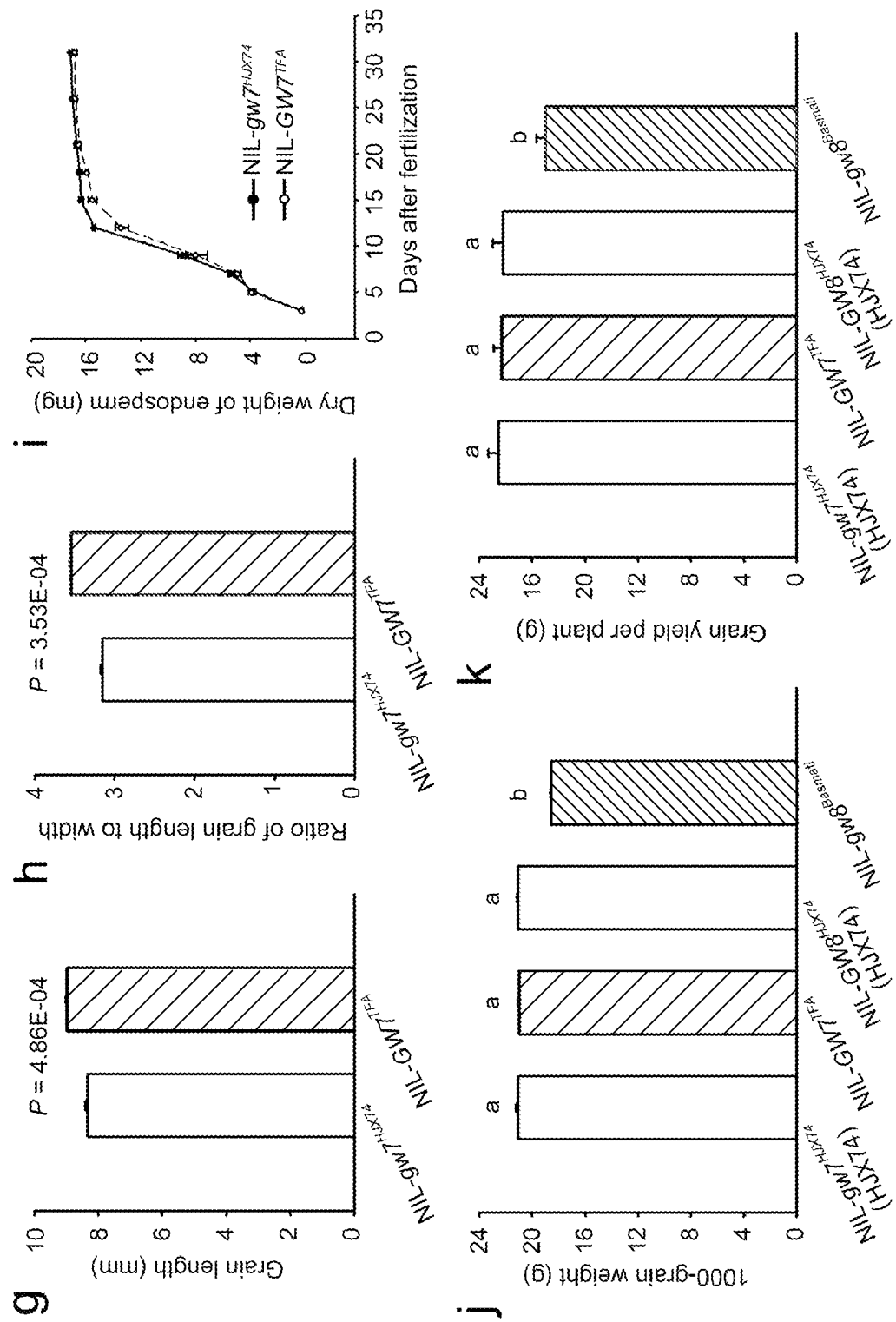

FIG. 3. A field trial of NIL-gw7$^{HJX74}$ and NIL-GW7TFA plants. (a) The morphology of NILs plants. Scale bar: 12 cm. (b) Plant height. (c) Heading date. (d) The number of tillers per plant. (e) The number of grains per panicle. (f) Grain width. (g) Grain length. (h) Ratio of grain length to width. Data shown as mean±s.e.m (n=60). A Student's t-test was used to generate the P values (panels b-h). (i) Time-course of endosperm dry weight increase. Data shown as mean±s.e.m (n=60). (j) 1,000 grain weight. Data shown as mean±s.e.m (n=180). (k) The overall grain yield per plant. Data shown as mean±s.e.m (n=300). All phenotypic data were measured from the paddy-grown plants under normal cultivation conditions. The presence of the same lowercase letter denotes a non-significant difference between means (P<0.05; panels j and k).

Figure 4:
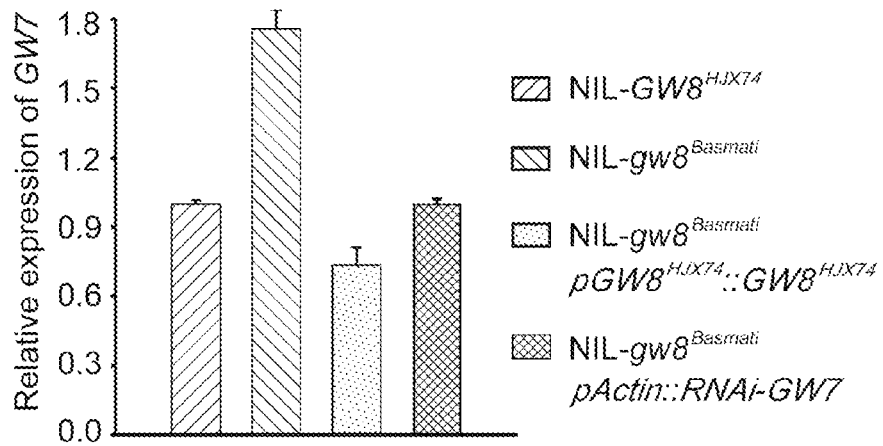
Figure 4:
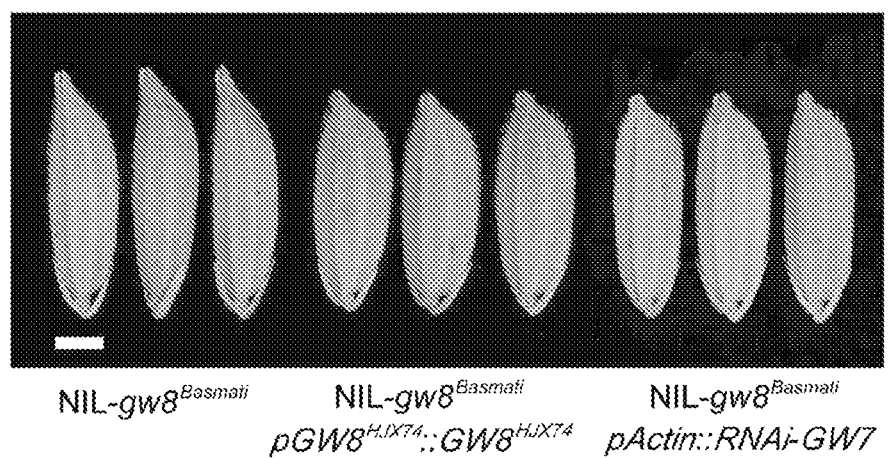
Figure 4:
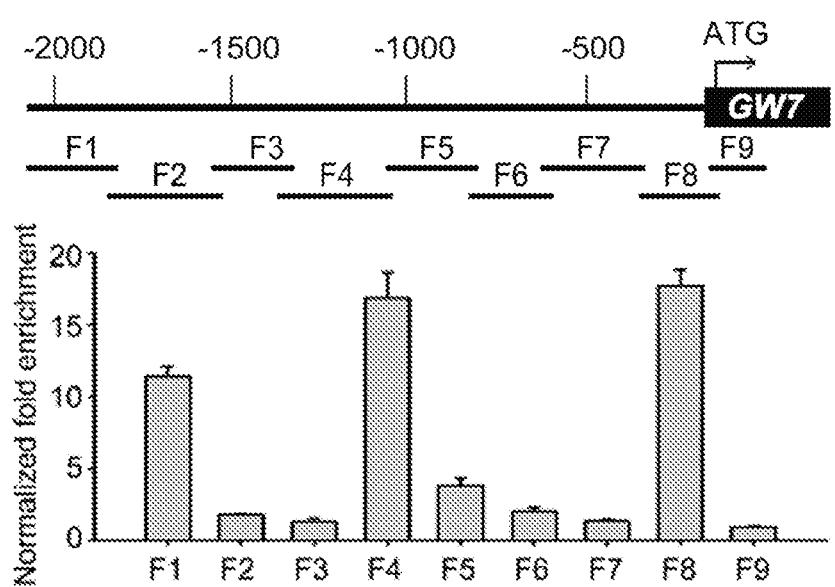
Figure 4:
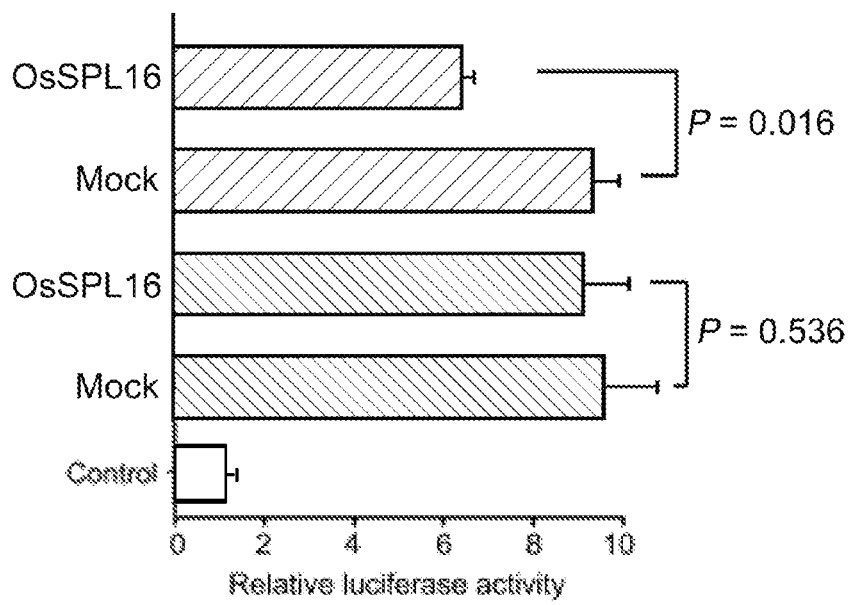
Figure 4:
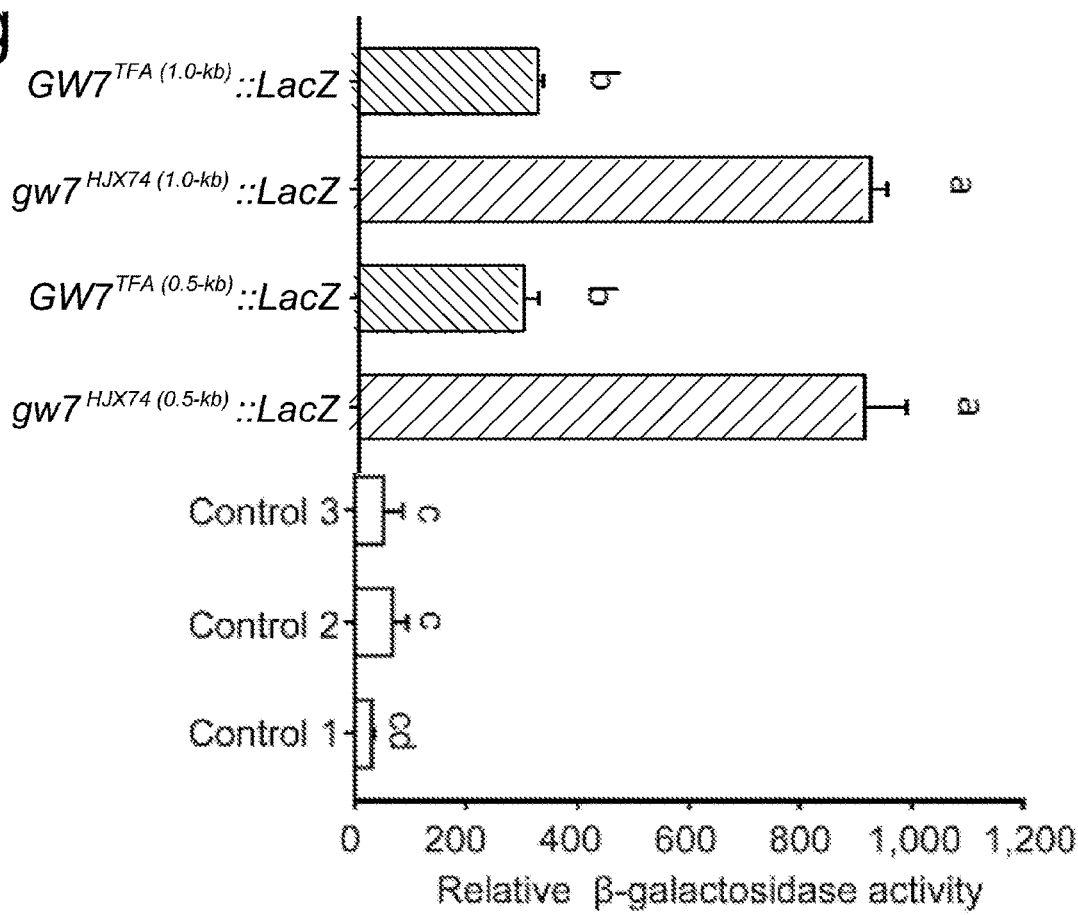

FIG. 4. OsSPL16 negatively regulates GW7 expression. (a) Effect of OsSPL16/GW8 on transcript abundance of GW7 in young panicles. Transcription relative to the level of NIL-GW8$^{HJX74}$ plants set to be one. Data shown as mean±s.e.m (n=3). (b) Grain size and shape formed by transgenic NIL-gw8 Basmati plants. Scale bar: 2 mm. (c) ChIP assays. The diagram depicts the putative GW7 promoter and regions of it used for ChIP-PCR analysis of extracts from young panicle of transgenic NIL-gw8 Basmati plants carrying pActin::myc-OsSPL16 construct. Data shown as mean±s.e.m (n=3). (d) EMSA assays. The GTAC motifs-containing DNA fragment (F8 shown in c) of the GW7 promoter was incubated with GST-OsSPL16 as indicated. Competition for OsSPL16 binding was performed with 10×, 20×, 30× and 50× cold probes containing the GTAC motifs, respectively. (e) OsSPL16 represses transcription of the GW7 gene promoter. Relative luciferase activity was monitored in rice protoplasts co-transfected with the different effector and reporter constructs. Mock: co-transfected with reporter constructs and an empty effector construct; negative control: co-transfected with effector construct and an empty reporter construct set to be one. Data shown as mean±s.e.m (n=3). A Student's t-test was used to generate the P values. (f) An 11 bp deletion and 18 bp insertion found in close proximity to the GTAC motifs in the GW7TFA allele. The variations were located in F8 fragment of the GW7 promoter shown in c. (g) Yeast one-hybrid assays. The DNA fragments of 0.5 kbp and 1.0 kbp upstream of the GW7 transcription start site were respectively amplified from either HJX74 or TFA plants, and then used to be constructed LacZ-expressing vectors[32]. Data shown as mean±s.e.m (n=3). The pB42AD and pLacZi2µ empty vectors, pB42AD::OsSPL16 and pLacZi2p empty vectors, and gw7$^{HJX74}$ (1.0-kb)::LacZ and empty pB42AD vectors were used as negative control 1, control 2 and control 3, respectively. The presence of the same lowercase letter denotes a non-significant difference between means (P<0.05).

Figure 5:
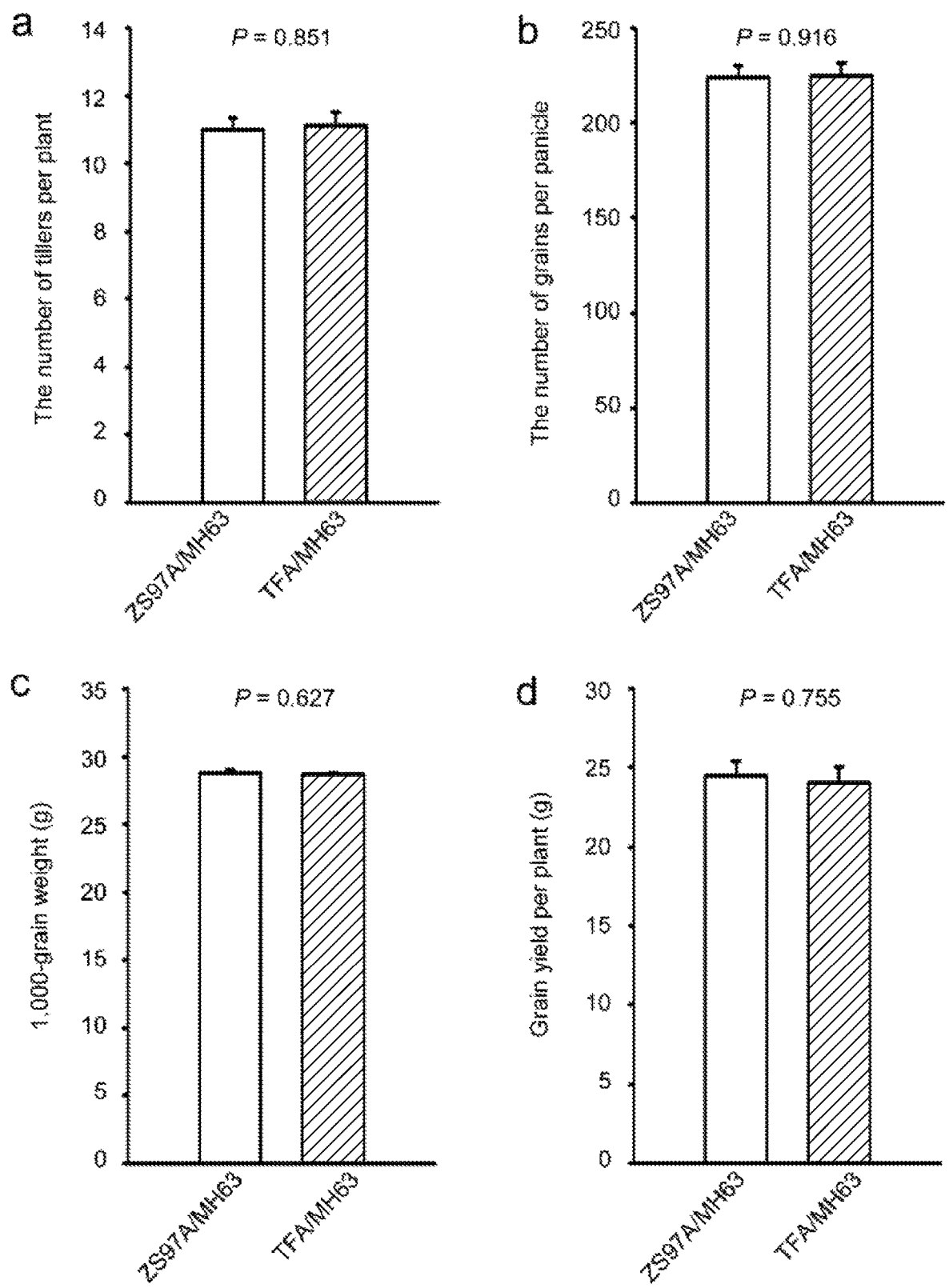

FIG. 5 The contrasting phenotype and grain yield of hybrid combinations ZS97A/MH63 and TFA/MH63. (a) Number of tillers per plant. (b) Number of grains per panicle. (c) 1,000-grain weight. (d) The overall grain yield per plant. All data were measured from the plants, which were grown with a distance of 20×20 cm in paddies under normal cultivation conditions. Data shown as mean±s.e.m (n=180). A Student's t-test was used to generate the P values.

Figure 6:
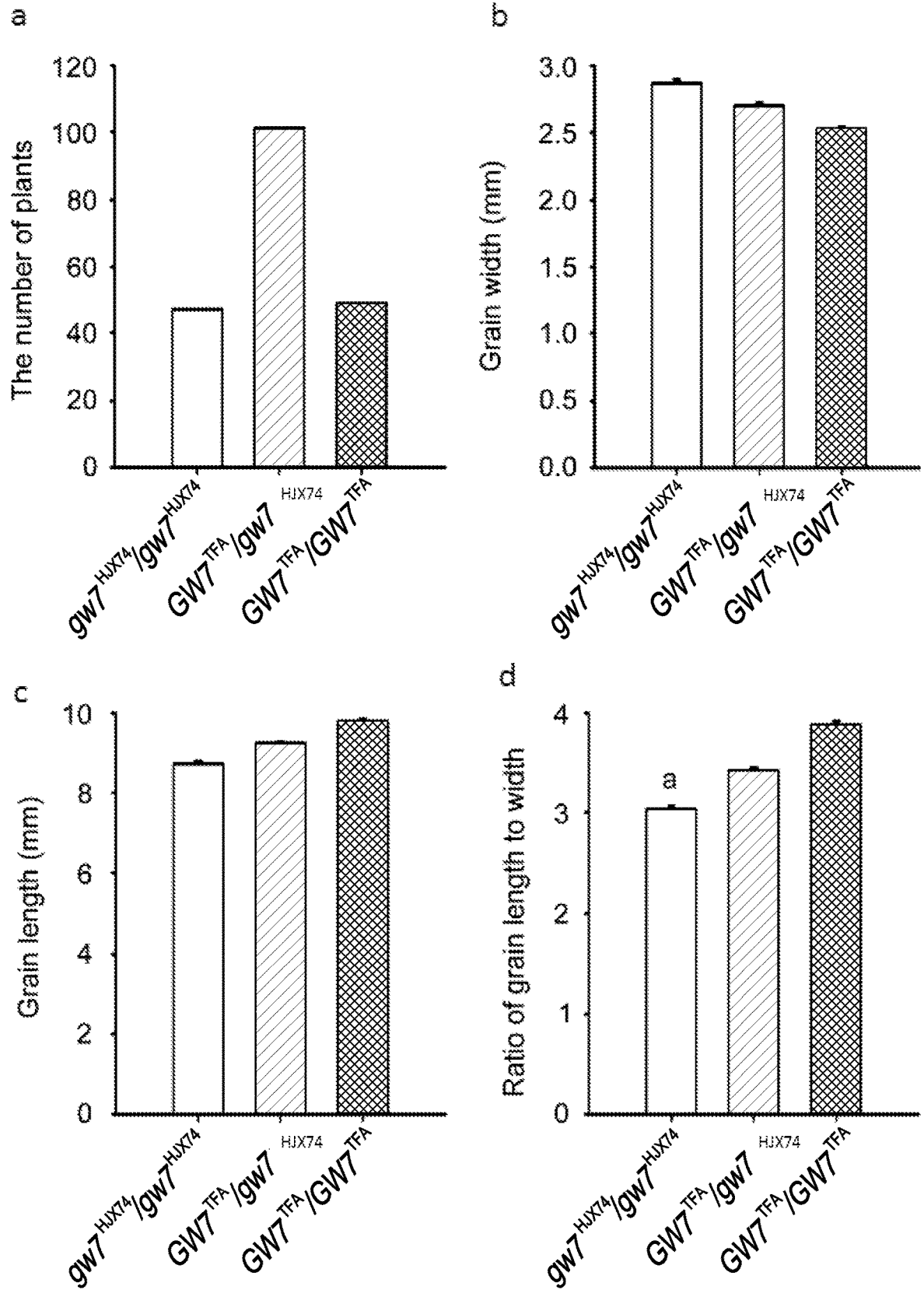

FIG. 6 The semidominant qGW7 allele from TFA was correlated with the formation of more slender grains. (a) Segregation of the BC1F2 population derived from the TFA and HJX74 (as the recurrent plant). Comparisons of (b) grain width, (c) grain length, (d) Ratio of grain length to width among homozygotes of the TFA qGW7 allele, heterozygotes of the TFA qGW7 and the HJX74 qGW7 allele, and homozygotes of the HJX74 qGW7 allele. Data shown as mean±s.e.m (n=120). The same lowercase letter denotes a non-significant difference between means (P<0.05).

Figure 7:
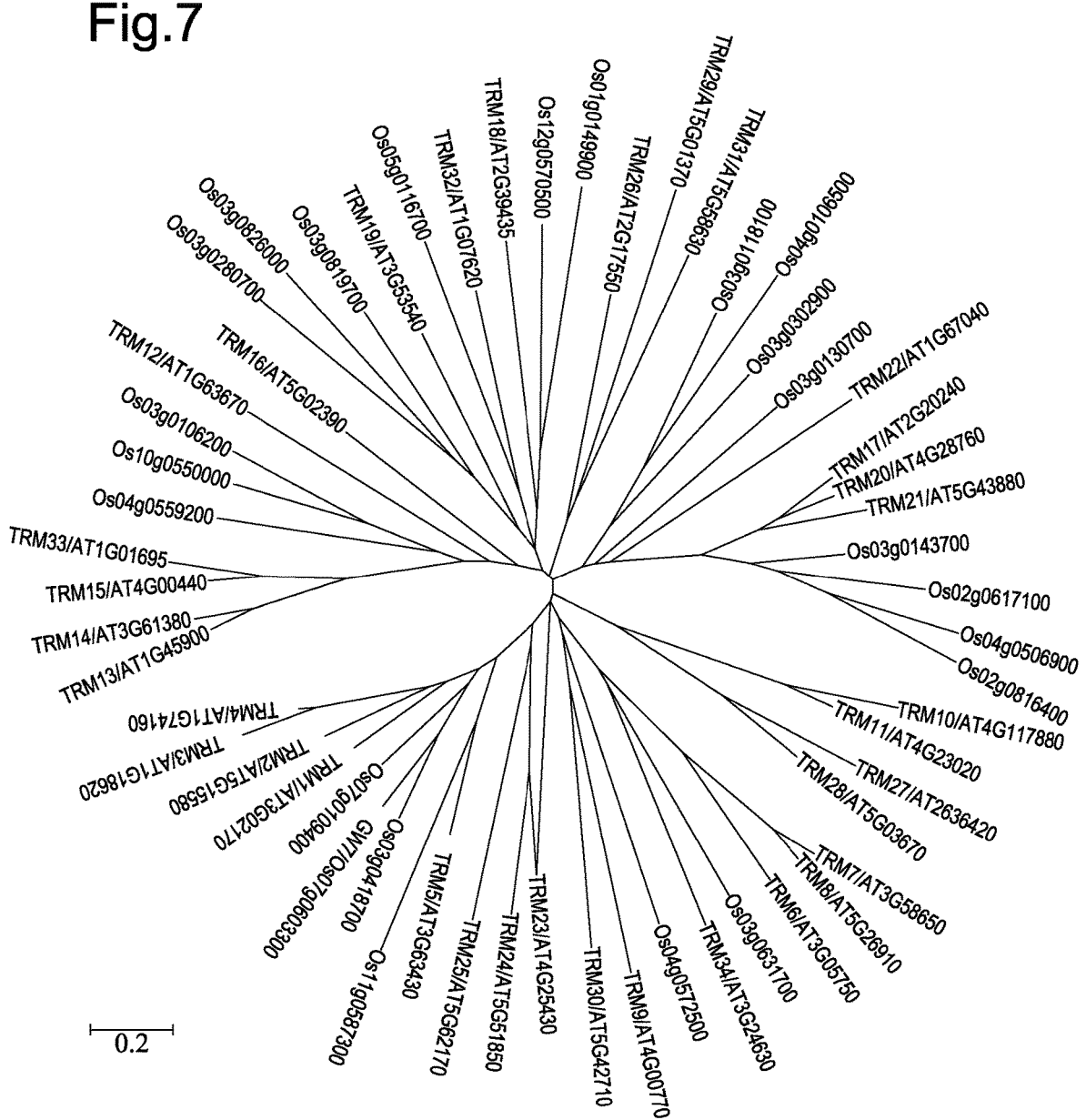

FIG. 7 Phylogenetic tree of TRM family proteins based on the protein sequences. The names of *Arabidopsis* and rice TRM genes were downloaded from the *Arabidopsis* Functional Genomics Network and the Rice Annotation Project Database FIG. 8 Homology analysis of GW7 protein sequence. The numbers on the right indicate the position of the residues in the full protein. Identical residues indicated by dark boxes, conserved residues indicated by grey boxes and variant residues by light boxes. The sequences of TuGW7 (EMS68230.1), ZmGW7 (DAA63511.1), SiGW7 (XP 002467688.1), TRM1/LNG2 (NP 566165.2), and the C-terminal motifs of human centrosomal protein CAP350 (NP 055625.4) and CEP350 (XP 006529970.1) were from NCBI. TRM1(At3g02170)

cDNA SEQ ID NO: 418, gDNA SEQ ID NO: 419, protein SEQ ID NO: 420>CAP350 (NP_055625.4)

cDNA SEQ ID NO: 421, gDNA SEQ ID NO: 422, protein SEQ ID NO: 423>CEP350 (XP_00652970.1)

cDNA SEQ ID NO: 424, gDNA SEQ ID NO: 425, protein SEQ ID NO: 426

Figure 9:
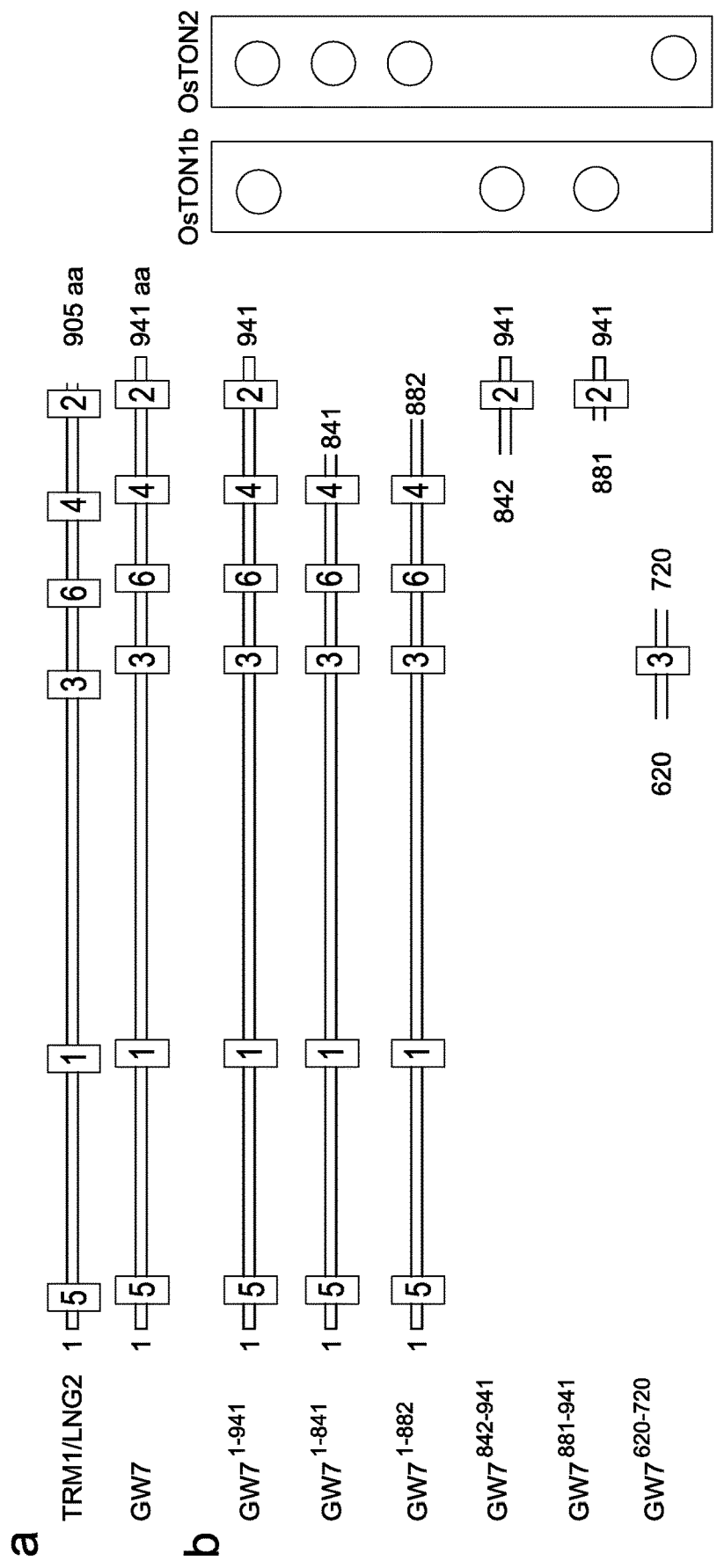

FIG. 9 The GW7 protein interacts with both OsTON1b and OsTON2. (a) Coloured boxes correspond to the position of the motif present in the GW7 and TRM1/LNG2 proteins. (b) The M2 motif of GW7 was involved in the interaction between GW7 and OsTON1b, and the M3 motif of GW7 was involved in the interaction between GW7 and OsTON2. A schematic representation of GW7 fragments tested for interaction using yeast two-hybrid assays.

Figure 10:
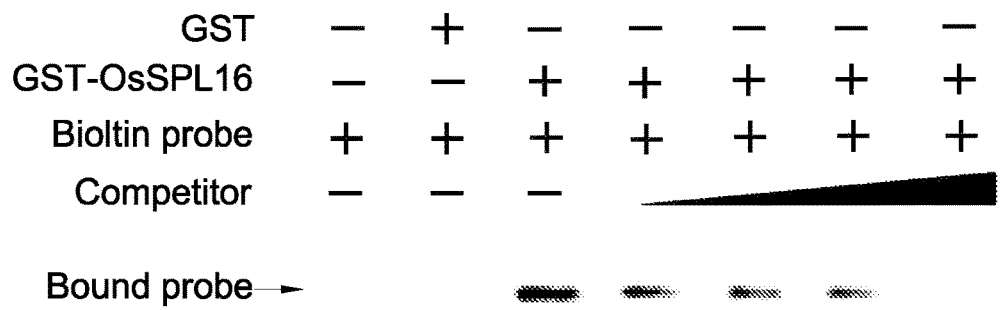
Figure 10:
Figure 10:
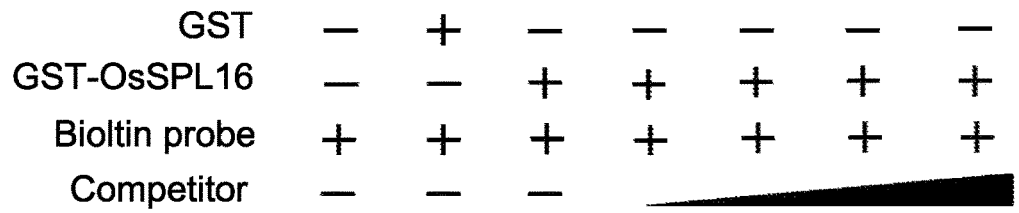
Figure 10:

FIG. 10 The DNA fragment (F8) containing two GATC motifs (a) or two mutated ATAC motifs (b) was incubated with GST-OsSPL16 as indicated. Competition for OsSPL16 binding was performed with 10×, 20×, 30× and 50× cold probes containing the GTAC motif, respectively.

Figure 11:
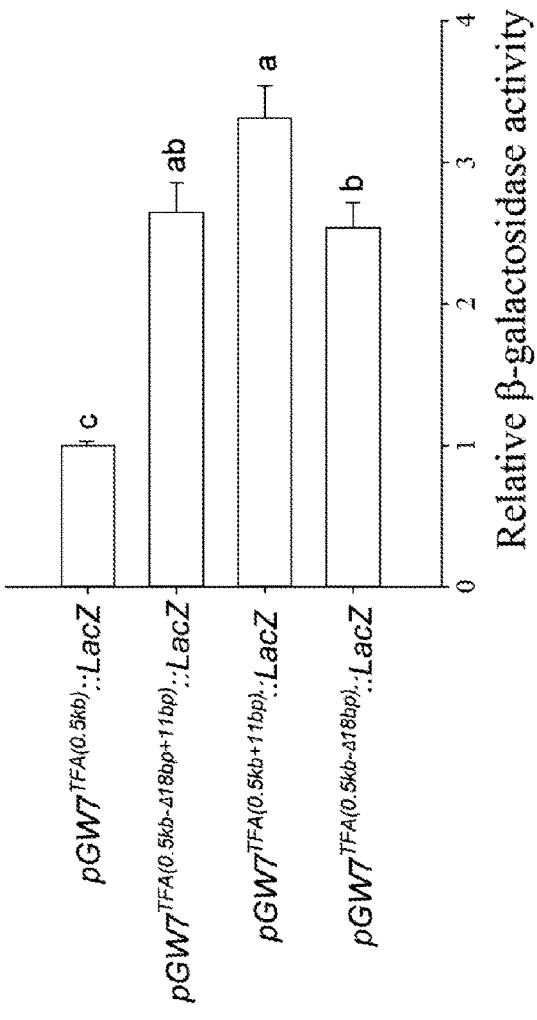

FIG. 11 Yeast one-hybrid assays. The 0.5 kbp TFA promoter fragments and the mutated-promoters, which contained an 18-bp deletion and/or an 11-bp insertion located at the F8 region, were used to analyse the binding activity of OsSPL16 to the GW7 promoter. Data shown as mean±s.e.m (n=3). The presence of the same lowercase letter denotes a non-significant difference between means (P<0.05).

Figure 12:
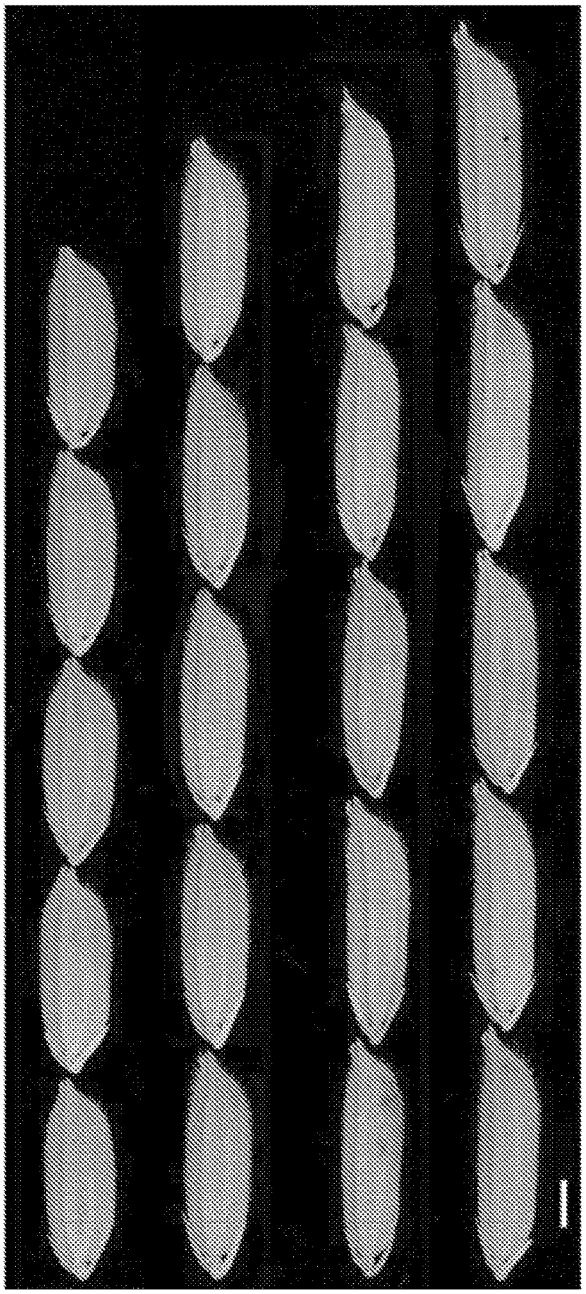

FIG. 12 Improving appearance quality of the rice grain by QTL pyramiding. The four contrasting allelic combinations of the qGW7 and qGS3 loci were assembled in a near isogenic HJX74 background. Scale bar: 2 mm.

Figure 13:
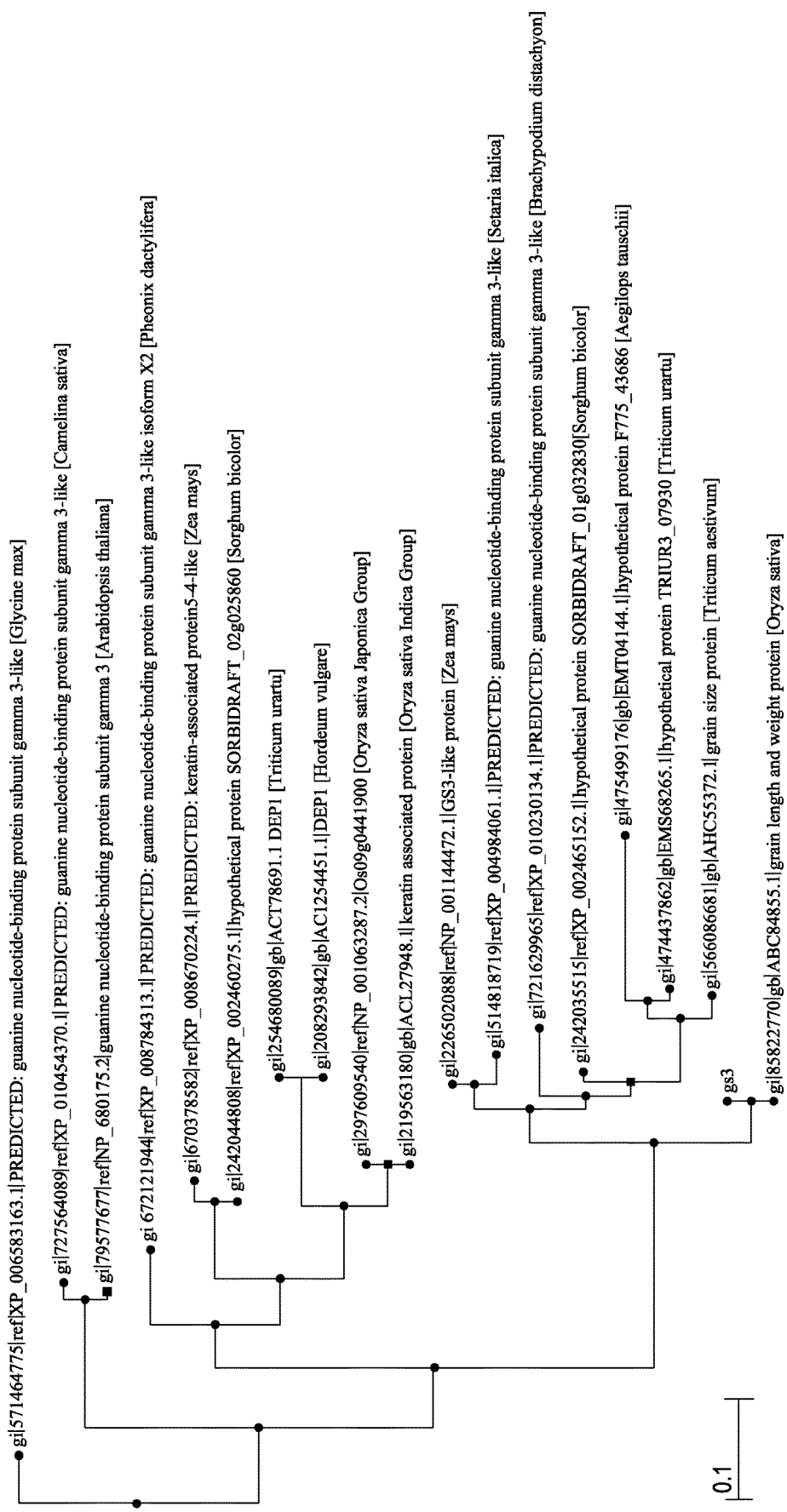

FIG. 13 GW7 homologs (SEQ ID NO: 1-3, 9-59).

Figure 14:
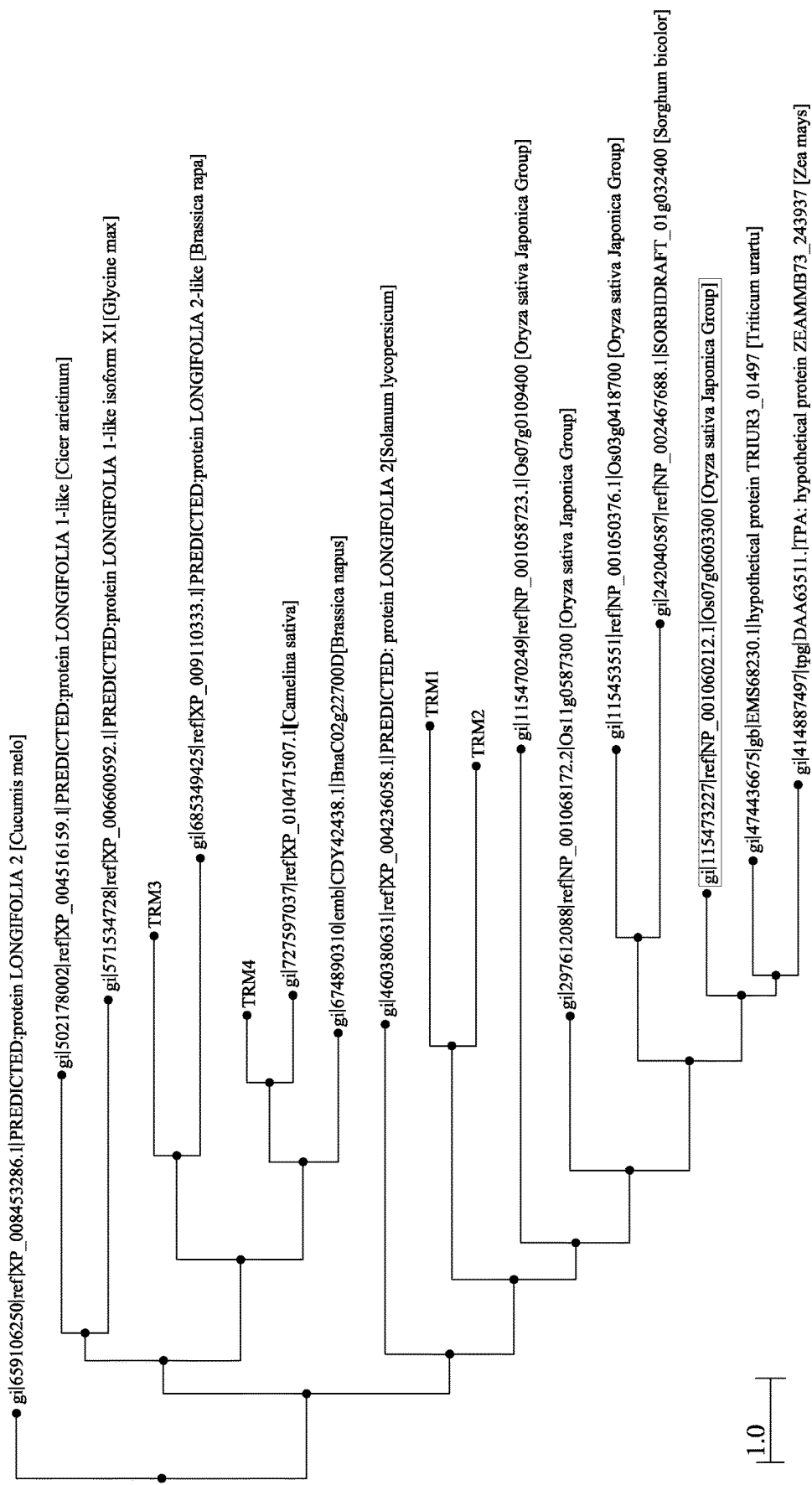

FIG. 14 GS3 homologs (SEQ ID NO: 5, 6, 7, 60-113).

FIG. 15 GW7 and GS3 sequences (SEQ ID NO: 1-8).

DETAILED DESCRIPTION

The present invention will now be further described. In the following passages, different aspects of the invention are defined in more detail. Each aspect so defined may be combined with any other aspect or aspects unless clearly indicated to the contrary. In particular, any feature indicated as being preferred or advantageous may be combined with any other feature or features indicated as being preferred or advantageous.

The practice of the present invention will employ, unless otherwise indicated, conventional techniques of botany, microbiology, tissue culture, molecular biology, chemistry, biochemistry, bioinformatics and recombinant DNA technology which are within the skill of the art. Such techniques are explained fully in the literature.

As used herein, the words "nucleic acid", "nucleic acid sequence", "nucleotide", "nucleic acid molecule" or "polynucleotide" are intended to include DNA molecules (e.g., cDNA or genomic DNA), RNA molecules (e.g., mRNA), naturally occurring, mutated, synthetic DNA or RNA molecules, and analogues of the DNA or RNA generated using nucleotide analogues. It can be single-stranded or double-stranded. Such nucleic acids or polynucleotides include, but are not limited to, coding sequences of structural genes, anti-sense sequences, and non-coding regulatory sequences that do not encode mRNAs or protein products. These terms also encompass a gene. The term "gene" or "gene sequence" is used broadly to refer to a DNA nucleic acid associated with a biological function. Thus, genes may include introns and exons as in the genomic sequence, or may comprise only a coding sequence as in cDNAs, and/or may include cDNAs in combination with regulatory sequences.

The terms "peptide", "polypeptide" and "protein" are used interchangeably herein and refer to amino acids in a polymeric form of any length, linked together by peptide bonds.

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) both (a) and (b)

are not located in their natural genetic environment or have been modified by genetic intervention techniques, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815 both incorporated by reference.

In certain embodiments, a transgenic plant for the purposes of the invention is thus understood as meaning, as above, that the nucleic acids used in the method of the invention are not at their natural locus in the genome of said plant, it being possible for the nucleic acids to be expressed homologously or heterologously. Thus, the plant expresses a transgene. However, as mentioned, in certain embodiments, transgenic also means that, while the nucleic acids according to the different embodiments of the invention are at their natural position in the genome of a plant, the sequence has been modified with regard to the natural sequence, and/or that the regulatory sequences of the natural sequences have been modified, for example by mutagenesis.

Transgenic is preferably understood as meaning the expression of the nucleic acids according to the invention at an unnatural locus in the genome, i.e. homologous or, preferably, heterologous expression of the nucleic acids takes place. According to the various of the invention that concern transgenic plants and related methods, the transgene is stably integrated into the plant and the plant is preferably homozygous for the transgene.

In certain aspects of the invention, the plants of the invention are mutant plants which have been genetically engineered, that is manipulated by human intervention. The plants of these aspects of the invention do not relate to natural variants which have not been manipulated by genetic engineering methods. Thus, the plants have been generated using genetic engineering methods, for example transgene expression, mutagenesis, gene targeting, gene silencing or genome editing as detailed below.

Thus, various aspects of the invention can involve recombinant DNA technology. The plant may be a transgenic plant in some embodiments, for example a plant which comprises a nucleic acid construct expressing a GW7 nucleic acid sequence or a plant comprising a transgene to silence gene expression of GS3. However, certain other aspects of the invention do not relate to transgenic plants but encompass plants that have been genetically altered in other ways using recombinant DNA technology. Thus, in certain embodiments, the plant does not carry a transgene, but is a mutant plant wherein the endogenous nucleic acid sequence encoding a GW7 or GS3 polypeptide or the endogenous GW7 or GS3 promoter sequence has been manipulated by human intervention to alter the function of the polypeptide.

In a first aspect, the invention relates to a plant wherein the expression of a nucleic acid sequence encoding a GW7 polypeptide or the activity of a GW7 polypeptide is increased.

The increase is relative to a control plant.

As explained above, in preferred embodiments, the plant is a genetically engineered plant. Thus, in preferred embodiments, the invention relates to a plant that has been generated by genetic engineering methods as described above and does not encompass naturally occurring varieties.

Thus, in preferred embodiments, the invention relates to a genetically engineered plant wherein the expression of a nucleic acid sequence encoding a GW7 polypeptide or the activity of a GW7 polypeptide is increased.

Figure 8:
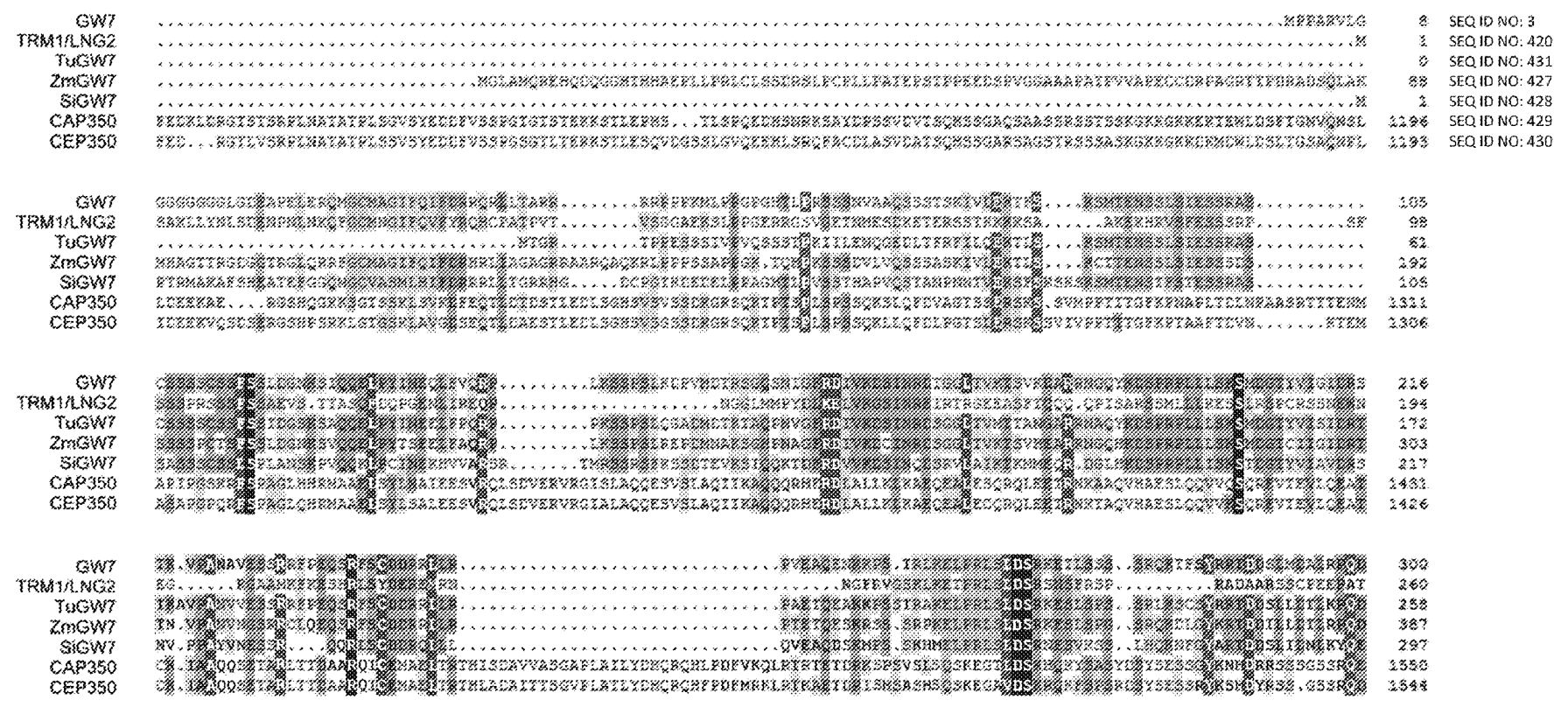
Figure 8:
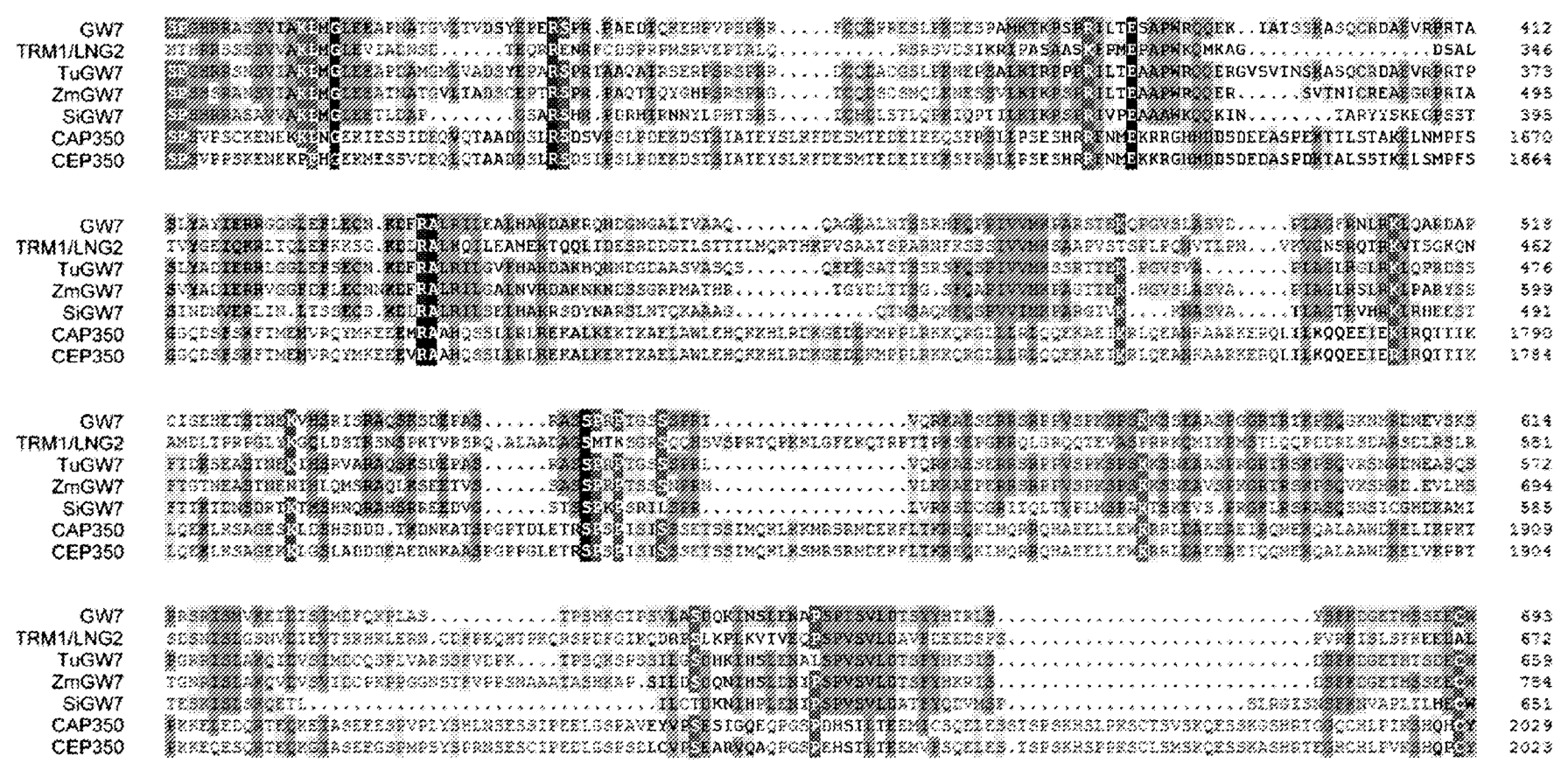
Figure 8:
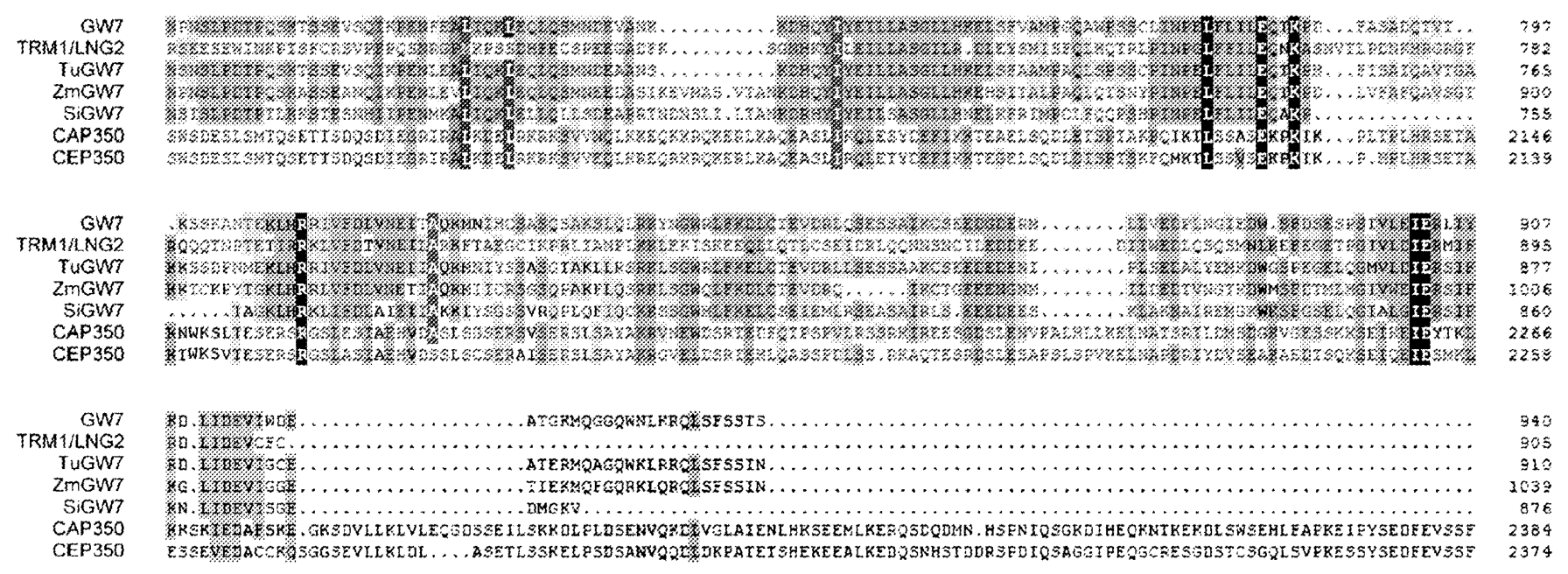

The term GW7 protein refers to a protein that is a member of the superfamily of TONNEAU1 (TON1[15]) recruiting motif proteins (TRM[16]) (FIG. 7). In *A. thaliana*, TRM1 which is synonymous with *LONGIFOLIA2*[21] (LNG2), has been identified as targeting TON1, a protein which shares similarity with the human centrosomal protein FOP[22], to the cortical microtubules[16,17]. The TONNEAU1 (TON1[15]) recruiting motif proteins (TRM[16]) share homology with C-terminal motifs of the human centrosomal proteins CEP350 and CAP350[17] (FIG. 8).

The TRM superfamily is identified by the presence of six highly significant sequence motifs disposed in the very same order along protein sequences. Their order along protein sequences is conserved (M5-M1-M3-M6-M4-M2) (FIG. 9a).

Thus, according to the various aspects of the invention, a GW7 polypeptide is characterized by the presence of at least one the following domains, preferably all of the following domains, or a functional domain with at least 50%, 55%, 60%, 65%, 70%, 75%, 80%, 85%, 90% or 95%, 96%, 97%, 98%, 99% sequence identity thereto:

```
Domain M1:
                                         (SEQ ID NO: 114)
ALRPQDSPGHRRASSVIAKLMGLEEAPN Domain M2:
                                         (SEQ ID NO: 115)
IEDWSFDSESPSTVLEIERLIYKDLIDEVI Domain M3:
                                         (SEQ ID NO: 116)
SLENAPSPISVLDTSYYHTRLSYS Domain M4:
                                         (SEQ ID NO: 117)
KLHRRIVFDLVNEITAQKMN Domain M5:
                                         (SEQ ID NO: 118)
ELERQMGCMAGIFQIFDRRQRLLTARR
```

In one embodiment, the GW7 polypeptide is OsGW7 comprising or consisting of SEQ ID NO: 3, a functional variant or homolog thereof. The nucleic acid sequence encoding OsGW7 comprises or consists of SEQ ID NO: 1 (genomic DNA) or 2 (cDNA) respectively. The promoter of OsGW7 comprises or consists of SEQ ID NO: 4.

In other embodiments, the aspects of the invention also relate to a functional variant or homologue of OsGW7/OsGW7 as explained below.

The inventors have shown in the examples that upregulation of the GW7 gene promotes the formation of more slender and longer grains thus increasing both grain quality and yield. Expression of a construct comprising a GW7 nucleic acid sequence in transgenic rice plants resulted in more slender and longer grains. Furthermore, the inventors have shown that *Arabidopsis* plants overexpressing OsGW7 showed increased polar cell elongation as manifested by long and narrow leaf blades. In one embodiment, the plant of the invention is a transgenic plant which expresses a nucleic acid construct comprising a GW7 nucleic acid sequence as defined in SEQ ID NO: 1 or 2, a homolog or a functional variant thereof and wherein said plant is not *Arabidopsis*.

In one embodiment, said plant is a transgenic plant which expresses a nucleic acid construct comprising or consisting of a OsGW7 nucleic acid sequence as defined in SEQ ID NO: 1 or 2 or a functional rice variant thereof.

In one embodiment of the various aspects of the invention, said nucleic acid construct further comprises a regulatory sequence. According to the various aspects of the invention, the term "regulatory element" is used interchangeably herein with "control sequence" and "promoter" and all terms are to be taken in a broad context to refer to regulatory nucleic acid sequences capable of effecting expression of the sequences to which they are ligated. The term "regulatory element" also includes terminator sequences which may be included 3' of the GW7 nucleic acid sequence. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences.

The term "regulatory element" as used herein also encompasses a synthetic fusion molecule or derivative that confers, activates or enhances expression of a nucleic acid molecule in a cell, tissue or organ.

In one embodiment, a plant promote is used. A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes are known to the skilled person and include for example beta-glucuronidase or beta-galactosidase.

According to the various aspects of the invention, the GW7 nucleic acid for expression in a plant as a transgene is operably linked to a regulatory sequence or element. The term "operably linked" as used herein refers to a functional linkage between the promoter sequence and the gene of interest, such that the promoter sequence is able to initiate transcription of the gene of interest.

In one preferred embodiment, the nucleic acid sequence may be expressed using a promoter that drives overexpression. Overexpression according to the invention means that the transgene is expressed at a level that is higher than expression of endogenous counterparts driven by their endogenous promoters. For example, overexpression may be carried out using a strong promoter, such as a constitutive promoter. A "constitutive promoter" refers to a promoter that is transcriptionally active during most, but not necessarily all, phases of growth and development and under most environmental conditions, in at least one cell, tissue or organ. Examples of constitutive promoters include the cauliflower mosaic virus promoter (CaMV35S or 19S), rice actin promoter, maize ubiquitin promoter, rubisco small subunit, maize or alfalfa H3 histone, OCS, SAD1 or 2, GOS2 or any promoter that gives enhanced expression.

Alternatively, enhanced or increased expression can be achieved by using transcription or translation enhancers or activators and may incorporate enhancers into the gene to further increase expression. Furthermore, an inducible expression system may be used, where expression is driven by a promoter induced by environmental stress conditions, in particular drought. The promoter may also be tissue-specific. The types of promoters listed above are described in the art. Other suitable promoters and inducible systems are also known to the skilled person.

In a one embodiment, the promoter is a constitutive or strong promoter. In one embodiment, the promoter is CaMV35S. In one embodiment, the promoter is a GW7 promoter of a modified GW7 promoter.

In one embodiment of the plant of the invention which is characterised by increased expression of a nucleic acid sequence encoding a GW7 polypeptide, for example a nucleic acid comprising or consisting of SEQ ID. NO: 1 or 2, a homolog or functional variant thereof, or increased activity of a GW7 polypeptide, said plant comprises a mutation in the promoter or coding sequence of said GW7 nucleic acid sequence. Thus, said plant does not express a transgene, but has been manipulated by genetic engineering methods to alter the nucleic acid sequence of the endogenous GW7 promoter or the nucleic acid sequence encoding GW7 to result in increased expression of the GW7 protein.

The inventors have shown that OsSPL16 controls grain shape via repression of OsGW7. Among three binding sites of OsSPL16 (FIG. 4c), an 11 bp deletion and 18 bp insertion located at F8 fragment were identified in close proximity to the GTAC motifs in the GW7$^{TFA}$ allele (FIG. 4f and table 3), yeast one-hybrid assays demonstrated that this variations were associated with the binding activity of OsSPL16 to the GW7 promoter (FIG. 4g and FIG. 11). Thus, preventing binding of the repressor to the GW7 promoter by manipulating the GW7 promoter sequence results in increased GW7 gene expression.

For example, according to the various aspects of the invention, said GW7 promoter is manipulated to prevent binding of a transcriptional repressor. Genome editing techniques can be used as described below.

In one embodiment, the mutation in the GW7 promoter comprises a deletion of at least 5, for example 5-20 residues at position −103 to −123 and/or an insertion of at least 5, for example 5-20 residues between the residues at position −144 to −145. In one embodiment, the deletion is 18 residues at position −103 to −115 as shown in table 3. In one embodiment, the insertion is 18 residues as shown in table 3.

In another embodiment, the promoter comprises all of the mutations as shown in table 3 FIG. 1f. In other words, the variations between GW7 and gw7 can be targeted.

In another embodiment, the targeted site of OsSPL16 GTAC can be altered or the nearby residues. Mutations in these areas consequently alter the expression of GW7.

There are number of genetic engineering techniques that can be used to introduce mutations into endogenous nucleic acid sequences, specifically GW7 and GS3 nucleic acid sequences, according to the various aspects of the invention, including mutagenesis methods and Zinc finger nucleases. Recently, genome editing techniques have emerged as alternative methods to conventional mutagenesis methods (such as physical and chemical mutagenesis) or methods using the expression of transgenes in plants to produce mutant plants with improved phenotypes that are important in agriculture. These techniques employ sequence-specific nucleases (SSNs) including zinc finger nucleases (ZFNs), transcription activator-like effector nucleases (TALENs), and the RNA-guided nuclease Cas9 (CRISPR/Cas9), which generate targeted DNA double-strand breaks (DSBs), which are then repaired mainly by either error-prone non-homologous end joining (NHEJ) or high-fidelity homologous recombination (HR). The SSNs have been used to create targeted knockout plants in various species ranging from the model plants, Arabidopsis and tobacco, to important crops, such as barley, soybean, rice and maize. Heritable gene modification has been demonstrated in Arabidopsis and rice using the CRISPR/Cas9 system and TALENs.

Targeted genome modification or targeted genome editing is a genome engineering technique that uses targeted DNA double-strand breaks (DSBs) to stimulate genome editing through homologous recombination (HR)-mediated recombination events. To achieve effective genome editing via introduction of site-specific DNA DSBs, four major classes of customizable DNA binding proteins can be used: meganucleases derived from microbial mobile genetic elements, ZF nucleases based on eukaryotic transcription factors, transcription activator-like effectors (TALEs) from Xanthomonas bacteria, and the RNA-guided DNA endonuclease Cas9 from the type II bacterial adaptive immune system CRISPR (clustered regularly interspaced short palindromic repeats). Meganuclease, ZF, and TALE proteins all recognize specific DNA sequences through protein-DNA interactions. Although meganucleases integrate its nuclease and DNA-binding domains, ZF and TALE proteins consist of individual modules targeting 3 or 1 nucleotides (nt) of DNA, respectively. ZFs and TALEs can be assembled in desired combinations and attached to the nuclease domain of FokI to direct nucleolytic activity toward specific genomic loci.

Upon delivery into host cells via the bacterial type III secretion system, TAL effectors enter the nucleus, bind to effector-specific sequences in host gene promoters and activate transcription. Their targeting specificity is determined by a central domain of tandem, 33-35 amino acid repeats. This is followed by a single truncated repeat of 20 amino acids. The majority of naturally occurring TAL effectors examined have between 12 and 27 full repeats.

These repeats only differ from each other by two adjacent amino acids, their repeat-variable di-residue (RVD). The RVD that determines which single nucleotide the TAL effector will recognize: one RVD corresponds to one nucleotide, with the four most common RVDs each preferentially associating with one of the four bases. Naturally occurring recognition sites are uniformly preceded by a T that is required for TAL effector activity. TAL effectors can be fused to the catalytic domain of the FokI nuclease to create a TAL effector nuclease (TALEN) which makes targeted DNA double-strand breaks (DSBs) in vivo for genome editing. The use of this technology in genome editing is well described in the art, for example in U.S. Pat. Nos. 8,440,431, 8,440,432 and 8,450,471. A set of customized plasmids can be used with the Golden Gate cloning method to assemble multiple DNA fragments. As described therein, the Golden Gate method uses Type IIS restriction endonucleases, which cleave outside their recognition sites to create unique 4 bp overhangs. Cloning is expedited by digesting and ligating in the same reaction mixture because correct assembly eliminates the enzyme recognition site. Assembly of a custom TALEN or TAL effector construct and involves two steps: (i) assembly of repeat modules into intermediary arrays of 1-10 repeats and (ii) joining of the intermediary arrays into a backbone to make the final construct.

Another genome editing method that can be used according to the various aspects of the invention is CRISPR. The use of this technology in genome editing is well described in the art, for example in U.S. Pat. No. 8,697,359 and references cited herein. In short, CRISPR is a microbial nuclease system involved in defense against invading phages and plasmids. CRISPR loci in microbial hosts contain a combination of CRISPR-associated (Cas) genes as well as non-coding RNA elements capable of programming the specificity of the CRISPR-mediated nucleic acid cleavage (sgRNA). Three types (I-III) of CRISPR systems have been identified across a wide range of bacterial hosts. One key feature of each CRISPR locus is the presence of an array of repetitive sequences (direct repeats) interspaced by short stretches of non-repetitive sequences (spacers). The non-coding CRISPR array is transcribed and cleaved within direct repeats into short crRNAs containing individual spacer sequences, which direct Cas nucleases to the target site (protospacer). The Type II CRISPR is one of the most well characterized systems and carries out targeted DNA double-strand break in four sequential steps. First, two non-coding RNA, the pre-crRNA array and tracrRNA, are transcribed from the CRISPR locus. Second, tracrRNA hybridizes to the repeat regions of the pre-crRNA and mediates the processing of pre-crRNA into mature crRNAs containing individual spacer sequences. Third, the mature crRNA:tracrRNA complex directs Cas9 to the target DNA via Watson-Crick base-pairing between the spacer on the crRNA and the protospacer on the target DNA next to the protospacer adjacent motif (PAM), an additional requirement for target recognition. Finally, Cas9 mediates cleavage of target DNA to create a double-stranded break within the protospacer.

Cas9 is thus the hallmark protein of the type II CRISPR-Cas system, and a large monomeric DNA nuclease guided to a DNA target sequence adjacent to the PAM (protospacer adjacent motif) sequence motif by a complex of two non-coding RNAs: CRIPSR RNA (crRNA) and trans-activating crRNA (tracrRNA). The Cas9 protein contains two nuclease domains homologous to RuvC and HNH nucleases. The HNH nuclease domain cleaves the complementary DNA strand whereas the RuvC-like domain cleaves the non-complementary strand and, as a result, a blunt cut is introduced in the target DNA. Heterologous expression of Cas9 together with an sgRNA can introduce site-specific double strand breaks (DSBs) into genomic DNA of live cells from various organisms. For applications in eukaryotic organisms, codon optimized versions of Cas9, which is originally from the bacterium Streptococcus pyogenes, have been used.

The single guide RNA (sgRNA) is the second component of the CRISPR/Cas system that forms a complex with the Cas9 nuclease. sgRNA is a synthetic RNA chimera created by fusing crRNA with tracrRNA. The sgRNA guide sequence located at its 5' end confers DNA target specificity. Therefore, by modifying the guide sequence, it is possible to create sgRNAs with different target specificities. The canonical length of the guide sequence is 20 bp. In plants, sgRNAs have been expressed using plant RNA polymerase III promoters, such as U6 and U3.

Thus, in one embodiment of the plants and methods described herein, the GW7 promoter or GW7 coding sequence can be manipulated by gene editing to alter binding with repressors, for example transcriptional repressors. In other embodiments, the GW7 promoter or GW7 coding sequence can be manipulated by other techniques, such as mutagenesis methods described elsewhere herein. Mutant plants can be screened for enhanced organ size and mutations in the GW7 promoter or GW7 coding sequence that lead to the phenotypes can be identified based on routine methods.

In another embodiment of the plant of the invention described above, the plant does not produce a functional GS3 polypeptide.

In particular, the invention also relates to a double mutant plant wherein the expression of a nucleic acid sequence encoding a GW7 polypeptide or the activity of a GW7 polypeptide is increased and wherein the expression of a nucleic acid sequence encoding a GS3 polypeptide or the activity of a GS3 polypeptide is reduced or abolished. For example, said plant expresses a nucleic acid construct comprising a GW7 nucleic acid sequence comprising or consisting of SEQ ID NO: 1 or 2, a homologue or a functional variant thereof. Said construct may comprise a regulatory sequence as defined herein, for example the CaMV35S promoter. In another embodiment, said plant comprises a mutation in the promoter or coding sequence of said GW7 nucleic acid sequence as described herein. In one embodiment, the expression of a nucleic acid sequence encoding a GS3 polypeptide or the activity of a GS3 polypeptide is reduced or abolished because said plant comprises a mutation in the promoter or coding sequence of said GS3 nucleic acid sequence. In one embodiment, the expression of a nucleic acid sequence encoding a GS3 polypeptide or the activity of a GS3 polypeptide is reduced or abolished because said plant comprises an RNA interference construct that reduces the expression of GS3, a functional variant or homologue thereof.

As explained above, in preferred embodiments, the plant is a genetically engineered plant. Thus, in preferred embodiments, the invention relates to a plant that has been generated by genetic engineering methods as described above and does not encompass naturally occurring varieties.

The term GS3 polypeptide refers to protein characterised by plant specific G-protein subunits. In rice, GS3 functions as a negative regulator for grain size. The OsGW3 gene (SEQ ID NO:5) consists of five exons and encodes 232 amino acids with a several distinct domains (SEQ ID NO:7). Comparative sequencing analysis identified a nonsense mutation, shared among all the large-grain varieties tested in comparison with the small grain varieties, in the second exon of the GS3 gene. This mutation causes a 178-aa truncation in the C-terminus of the predicted protein[14] (US2010/001791). The wild-type isoform is composed of four putative domains: a plant-specific organ size regulation (OSR) domain in the N terminus, a transmembrane domain, a tumor necrosis factor receptor/nerve growth factor receptor (TNFR/NGFR) family cysteine-rich domain, and a von Willebrand factor type C (VWFC) in the C terminus. These domains function differentially in grain size regulation. The OSR domain is both necessary and sufficient for functioning as a negative regulator. The wild-type allele corresponds to medium grain. Loss of function of OSR results in long grain. The C-terminal TNFR/NGFR and VWFC domains show an inhibitory effect on the OSR function; loss-of function mutations of these domains produced very short grain. Overexpression of GS3 reduces plant size and grain length[32]. Thus, combining a loss of function mutation in GS3 with an increase in expression of GW7 or an increase in the activity of GW7 results in a significant improvement of organ size as shown in the examples.

Thus, according to the various aspects of the invention, a GS3 polypeptide is characterized by the presence of the following domains or domains with at least 75% homology thereto:
OSR or PEBP-like domain: SEQ ID NO: 123 PAPPDPP-CGRHRLQLAVDALHREIGFLEGEINSIEGIHAASRC-CREVDEFIGRT
TNFR/NGFR family cysteine-rich domain: SEQ ID NO: 124 CSSSSSSSFNLKRPSCCCNCNCNCCSSSSSSC-GAALTKSPC
von Willebrand factor type C (VWFC) in the C terminus: SEQ ID NO: 125 CASCSCSPPCACCAPPCAGC-SCRCTCPCPCPGGCSCACPACRCCCGVPRCCPPCL
Transmembrane REGION: SEQ ID NO: 126 region ASAC-CLSYLSWICCCSSAAG To manipulate GS3 resulting in GS3 loss of function, the OSR domain can be targeted, for example by genome editing as explained elsewhere herein. Alternatively, loss of function mutants can be produced which produce no GS3 transcript or a truncated GS3 transcript. For example, the mutation can reside in the second exon which results in a 1 truncation in the C-terminus of the protein.

In one embodiment, the GS3 polypeptide is OsGS3 comprises or consists of SEQ ID NO: 7, a functional variant or homologue thereof. The nucleic acid sequence encoding OsGS3 comprises or consists in SEQ ID NO: 6 (genomic DNA) and 5 (cDNA) respectively. The promoter of OsGS3 comprises or consists of SEQ ID NO: 8.

In another embodiment, the GS3 polypeptide is a functional variant or homologue of OsGS3 as described below.

For example, the plant is a reduction (knock down) or loss of function (knock out) mutant wherein the function of the GS3 nucleic acid sequence is reduced or lost compared to a wild type control plant. To this end, a mutation is introduced into the GS3 nucleic acid sequence or the corresponding promoter sequence which disrupts the transcription of the gene leading to a gene product which is not functional or has a reduced function. The mutation may be a deletion, insertion or substitution. The expression of active protein may thus be abolished by mutating the nucleic acid sequences in the plant cell which encode the GS3 polypeptide and regenerating a plant from the mutated cell. The nucleic acids may be mutated by insertion or deletion of one or more nucleotides. Techniques for the inactivation or knockout of target genes are well-known in the art. These techniques include gene target using vectors that target the gene of interest and which allow integration allows for integration of transgene at a specific site. The targeting construct is engineered to recombine with the target gene, which is accomplished by incorporating sequences from the gene itself into the construct. Recombination then occurs in the region of that sequence within the gene, resulting in the insertion of a foreign sequence to disrupt the gene. With its sequence interrupted, the altered gene will be translated into a non-functional protein, if it is translated at all. Other techniques include genome editing (targeted genome engineering) as described below. Using either of these techniques, in preferred embodiment, conserved domains which confer function of GS3 are modified so that no functional protein is produced.

A skilled person will know that in addition to genome editing described in detail herein, further approaches can be used to generate mutants, such as GS3 loss of function mutants or mutants with mutations in the GW7 promoter or coding sequence according to the various aspects of the invention. In one embodiment, insertional mutagenesis is used, for example using T-DNA mutagenesis (which inserts pieces of the T-DNA from the *Agrobacterium tumefaciens* T-Plasmid into DNA causing either loss of gene function or gain of gene function mutations), site-directed nucleases (SDNs) or transposons as mutagens. Insertional mutagenesis is an alternative means of disrupting gene function and is based on the insertion of foreign DNA into the gene of interest (see Krysan et al, The Plant Cell, Vol. 11, 2283-2290, December 1999).

In one embodiment, as discussed in the examples, T-DNA may be used as an insertional mutagen which disrupts target gene expression. T-DNA not only disrupts the expression of the gene into which it is inserted, but also acts as a marker for subsequent identification of the mutation. Since the sequence of the inserted element is known, the gene in which the insertion has occurred can be recovered, using various cloning or PCR-based strategies. The insertion of a piece of T-DNA on the order of 5 to 25 kb in length generally produces a disruption of gene function. If a large enough population of T-DNA transformed lines is generated, there are reasonably good chances of finding a transgenic plant carrying a T-DNA insert within any gene of interest. Transformation of spores with T-DNA is achieved by an *Agrobacterium*-mediated method which involves exposing plant cells and tissues to a suspension of *Agrobacterium* cells.

The details of this method are well known to a skilled person. In short, plant transformation by *Agrobacterium* results in the integration into the nuclear genome of a sequence called T-DNA, which is carried on a bacterial plasmid. The use of T-DNA transformation leads to stable single insertions. Further mutant analysis of the resultant transformed lines is straightforward and each individual insertion line can be rapidly characterized by direct sequencing and analysis of DNA flanking the insertion. Gene expression in the mutant is compared to expression of the GS3 nucleic acid sequence in a wild type plant and phenotypic analysis is also carried out. Other techniques for insertional mutagenesis include the use of transposons.

In another embodiment, mutagenesis is physical mutagenesis, such as application of ultraviolet radiation, X-rays, gamma rays, fast or thermal neutrons or protons. The targeted population can then be screened to identify a GS3 loss of function mutant.

In another embodiment of the various aspects of the invention, the plant is a mutant plant derived from a plant population mutagenised with a mutagen. The mutagen may be fast neutron irradiation or a chemical mutagen, for example selected from the following non-limiting list: ethyl methanesulfonate (EMS), methylmethane sulfonate (MMS), N-ethyl-N-nitrosurea (ENU), triethylmelamine (1'EM), N-methyl-N-nitrosourea (MNU), procarbazine, chlorambucil, cyclophosphamide, diethyl sulfate, acrylamide monomer, melphalan, nitrogen mustard, vincristine, dimethylnitosamine, N-methyl-N'-nitro-Nitrosoguanidine (MNNG), nitrosoguanidine, 2-aminopurine, 7,12 dimethyl-benz(a)anthracene (DMBA), ethylene oxide, hexamethylphosphoramide, bisulfan, diepoxyalkanes (diepoxyoctane (DEO), diepoxybutane (BEB), and the like), 2-methoxy-6-chloro-9 [3-(ethyl-2-chloroethyl)aminopropylamino]acridine dihydrochloride (ICR-170) or formaldehyde.

In one embodiment, the method used to create and analyse mutations is targeting induced local lesions in genomes (TLLING), reviewed in Henikoff et al, 2004. In this method, seeds are mutagenised with a chemical mutagen, for example EMS. The resulting M1 plants are self-fertilised and the M2 generation of individuals is used to prepare DNA samples for mutational screening. DNA samples are pooled and arrayed on microtiter plates and subjected to gene specific PCR. The PCR amplification products may be screened for mutations in the GS3 target gene using any method that identifies heteroduplexes between wild type and mutant genes. For example, but not limited to, denaturing high pressure liquid chromatography (dHPLC), constant denaturant capillary electrophoresis (CDCE), temperature gradient capillary electrophoresis (TGCE), or by fragmentation using chemical cleavage. Preferably the PCR amplification products are incubated with an endonuclease that preferentially cleaves mismatches in heteroduplexes between wild type and mutant sequences. Cleavage products are electrophoresed using an automated sequencing gel apparatus, and gel images are analyzed with the aid of a standard commercial image-processing program. Any primer specific to the GS3 nucleic acid sequence may be utilized to amplify the GS3 nucleic acid sequence within the pooled DNA sample. Preferably, the primer is designed to amplify the regions of the GS3 gene where useful mutations are most likely to arise, specifically in the areas of the GS3 gene that are highly conserved and/or confer activity as explained elsewhere. To facilitate detection of PCR products on a gel, the PCR primer may be labelled using any conventional labelling method.

Rapid high-throughput screening procedures thus allow the analysis of amplification products for identifying a mutation conferring the reduction or inactivation of the expression of the target gene as compared to a corresponding non-mutagenised wild type plant. Once a mutation is identified in a gene of interest, the seeds of the M2 plant carrying that mutation are grown into adult M3 plants and screened for the phenotypic characteristics associated with the target gene GS3. Loss of and reduced function mutants with increased organ size compared to a control can thus be identified.

In another embodiment, RNA-mediated gene suppression or RNA silencing may be used to achieve silencing of the target nucleic acid sequence. "Gene silencing" is a term generally used to refer to suppression of expression of a gene via sequence-specific interactions that are mediated by RNA molecules. The degree of reduction may be so as to totally abolish production of the encoded gene product, but more usually the abolition of expression is partial, with some degree of expression remaining. The term should not therefore be taken to require complete "silencing" of expression.

Transgenes may be used to suppress endogenous plant genes. This was discovered originally when chalcone synthase transgenes in *petunia* caused suppression of the endogenous chalcone synthase genes and indicated by easily visible pigmentation changes. Subsequently it has been described how many, if not all plant genes can be "silenced" by transgenes. Gene silencing requires sequence similarity between the transgene and the gene that becomes silenced. This sequence homology may involve promoter regions or coding regions of the silenced target gene. When coding regions are involved, the transgene able to cause gene silencing may have been constructed with a promoter that would transcribe either the sense or the antisense orientation of the coding sequence RNA. It is likely that the various examples of gene silencing involve different mechanisms that are not well understood. In different examples there may be transcriptional or post-transcriptional gene silencing and both may be used according to the methods of the invention.

The mechanisms of gene silencing and their application in genetic engineering, which were first discovered in plants in the early 1990s and then shown in *Caenorhabditis elegans* are extensively described in the literature.

RNA-mediated gene suppression or RNA silencing according to the methods of the invention includes co-suppression wherein over-expression of the target sense RNA or mRNA, that is the GS3 sense RNA or mRNA, leads to a reduction in the level of expression of the genes concerned. RNAs of the transgene and homologous endogenous gene are co-ordinately suppressed. Other techniques used in the methods of the invention include antisense RNA to reduce transcript levels of the endogenous target gene in a plant. In this method, RNA silencing does not affect the transcription of a gene locus, but only causes sequence-specific degradation of target mRNAs. An "antisense" nucleic acid sequence comprises a nucleotide sequence that is complementary to a "sense" nucleic acid sequence encoding a GS3 protein, or a part of the protein, i.e. complementary to the coding strand of a double-stranded cDNA molecule or complementary to an mRNA transcript sequence. The antisense nucleic acid sequence is preferably complementary to the endogenous GS3 gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire GS3 nucleic acid sequence, but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine-substituted nucleotides may be used. Examples of modified nucleotides that may be used to generate the antisense nucleic acid sequences are well known in the art. The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention hybridize with or bind to mRNA transcripts and/or insert into genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using vectors.

RNA interference (RNAi) is another post-transcriptional gene-silencing phenomenon which may be used according to the methods of the invention. This is induced by double-stranded RNA in which mRNA that is homologous to the dsRNA is specifically degraded. It refers to the process of sequence-specific post-transcriptional gene silencing mediated by short interfering RNAs (siRNA). The process of RNAi begins when the enzyme, DICER, encounters dsRNA and chops it into pieces called small-interfering RNAs (siRNA). This enzyme belongs to the RNase III nuclease family. A complex of proteins gathers up these RNA remains and uses their code as a guide to search out and destroy any RNAs in the cell with a matching sequence, such as target mRNA.

Artificial and/or natural microRNAs (miRNAs) may be used to knock out gene expression and/or mRNA translation. MicroRNAs (miRNAs) miRNAs are typically single stranded small RNAs typically 19-24 nucleotides long. Most plant miRNAs have perfect or near-perfect complementarity with their target sequences. However, there are natural targets with up to five mismatches. They are processed from longer non-coding RNAs with characteristic fold-back structures by double-strand specific RNases of the Dicer family Upon processing, they are incorporated in the RNA-induced silencing complex (RISC) by binding to its main component, an Argonaute protein. miRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes. Artificial microRNA (amiRNA) technology has been applied in *Arabidopsis thaliana* and other plants to efficiently silence target genes of interest. The design principles for amiRNAs have been generalized and integrated into a Web-based tool.

Thus, according to the various aspects of the invention a plant may be transformed to introduce a RNAi, shRNA, snRNA, dsRNA, siRNA, miRNA, ta-siRNA, amiRNA or cosuppression molecule that has been designed to target the expression of an GS3 nucleic acid sequence and selectively decreases or inhibits the expression of the gene or stability of its transcript. Preferably, the RNAi, snRNA, dsRNA, shRNA siRNA, miRNA, amiRNA, ta-siRNA or cosuppression molecule used according to the various aspects of the invention comprises a fragment of at least 17 nt, preferably 22 to 26 nt and can be designed on the basis of the information shown in SEQ ID NO: 1. Guidelines for designing effective siRNAs are known to the skilled person. Briefly. a short fragment of the target gene sequence (e.g., 19-40 nucleotides in length) is chosen as the target sequence of the siRNA of the invention. The short fragment of target gene sequence is a fragment of the target gene mRNA. In preferred embodiments, the criteria for choosing a sequence fragment from the target gene mRNA to be a candidate siRNA molecule include 1) a sequence from the target gene mRNA that is at least 50-100 nucleotides from the 5' or 3' end of the native mRNA molecule, 2) a sequence from the target gene mRNA that has a G/C content of between 30% and 70%, most preferably around 50%, 3) a sequence from the target gene mRNA that does not contain repetitive sequences (e.g., AAA, CCC, GGG, TTT, AAAA, CCCC, GGGG, TTTT), 4) a sequence from the target gene mRNA that is accessible in the mRNA, 5) a sequence from the target gene mRNA that is unique to the target gene, 6) avoids regions within 75 bases of a start codon. The sequence fragment from the target gene mRNA may meet one or more of the criteria identified above. The selected gene is introduced as a nucleotide sequence in a prediction program that takes into account all the variables described above for the design of optimal oligonucleotides. This program scans any mRNA nucleotide sequence for regions susceptible to be targeted by siRNAs. The output of this analysis is a score of possible siRNA oligonucleotides. The highest scores are used to design double stranded RNA oligonucleotides that are typically made by chemical synthesis. In addition to siRNA which is complementary to the mRNA target region, degenerate siRNA sequences may be used to target homologous regions. siRNAs according to the invention can be synthesized by any method known in the art. RNAs are preferably chemically synthesized using appropriately protected ribonucleoside phosphoramidites and a conventional DNA/RNA synthesizer. Additionally, siRNAs can be obtained from commercial RNA oligonucleotide synthesis suppliers.

siRNA molecules according to the aspects of the invention may be double stranded. In one embodiment, double stranded siRNA molecules comprise blunt ends. In another embodiment, double stranded siRNA molecules comprise overhanging nucleotides (e.g., 1-5 nucleotide overhangs, preferably 2 nucleotide overhangs). In some embodiments, the siRNA is a short hairpin RNA (shRNA); and the two strands of the siRNA molecule may be connected by a linker region (e.g., a nucleotide linker or a non-nucleotide linker). The siRNAs of the invention may contain one or more modified nucleotides and/or non-phosphodiester linkages. Chemical modifications well known in the art are capable of increasing stability, availability, and/or cell uptake of the siRNA. The skilled person will be aware of other types of chemical modification which may be incorporated into RNA molecules.

In one embodiment, recombinant DNA constructs as described in U.S. Pat. No. 6,635,805, incorporated herein by reference, may be used.

The silencing RNA molecule is introduced into the plant using conventional methods, for example a vector and Agrobacterium-mediated transformation. Stably transformed plants are generated and expression of the GS3 gene compared to a wild type control plant is analysed.

Silencing of the GS3 nucleic acid sequence may also be achieved using virus-induced gene silencing.

Thus, in one embodiment of the invention, the plant expresses a nucleic acid construct comprising a RNAi, shRNA snRNA, dsRNA, siRNA, miRNA, ta-siRNA, amiRNA or co-suppression molecule that targets the GS3 nucleic acid sequence as described herein and reduces expression of the endogenous GS3 nucleic acid sequence. A gene is targeted when, for example, the RNAi, snRNA, dsRNA, siRNA, shRNA miRNA, ta-siRNA, amiRNA or cosuppression molecule selectively decreases or inhibits the expression of the gene compared to a control plant. Alternatively, a RNAi, snRNA, dsRNA, siRNA, miRNA, ta-siRNA, amiRNA or cosuppression molecule targets a GS3 nucleic acid sequence when the RNAi, shRNA snRNA, dsRNA, siRNA, miRNA, ta-siRNA, amiRNA or cosuppression molecule hybridises under stringent conditions to the gene transcript.

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

In one embodiment, the suppressor nucleic acids may be anti-sense suppressors of expression of the GS3 polypeptides. In using anti-sense sequences to down-regulate gene expression, a nucleotide sequence is placed under the control of a promoter in a "reverse orientation" such that transcription yields RNA which is complementary to normal mRNA transcribed from the "sense" strand of the target gene.

An anti-sense suppressor nucleic acid may comprise an anti-sense sequence of at least 10 nucleotides from the target nucleotide sequence. It may be preferable that there is complete sequence identity in the sequence used for down-regulation of expression of a target sequence, and the target sequence, although total complementarity or similarity of sequence is not essential. One or more nucleotides may differ in the sequence used from the target gene. Thus, a sequence employed in a down-regulation of gene expression in accordance with the present invention may be a wild-type sequence (e.g. gene) selected from those available, or a variant of such a sequence.

The sequence need not include an open reading frame or specify an RNA that would be translatable. It may be preferred for there to be sufficient homology for the respective anti-sense and sense RNA molecules to hybridise. There may be down regulation of gene expression even where there is about 5%, 10%, 15% or 20% or more mismatch between the sequence used and the target gene. Effectively, the homology should be sufficient for the down-regulation of gene expression to take place.

Suppressor nucleic acids may be operably linked to tissue-specific or inducible promoters. For example, integument and seed specific promoters can be used to specifically down-regulate a GS3 nucleic acid in developing ovules and seeds to increase final seed size.

Nucleic acids which suppresses expression of a GS3 polypeptide as described herein may be operably linked to a heterologous regulatory-sequence, such as a promoter, for example a constitutive, inducible, tissue-specific or developmental specific promoter. The construct or vector may be transformed into plant cells and expressed as described herein. Plant cells comprising such vectors are also within the scope of the invention.

In another aspect, the invention relates to a silencing construct which targets GS3 obtainable or obtained by a method as described herein and to a plant or bacterial cell comprising such construct.

As explained above, various aspects of the invention also encompass functional variant, part or homologue of OsGW7. Furthermore, various aspects of the invention also encompass o functional variant, part or homologue of OsGS3.

The term "functional" refers to the biological function of a polypeptide or nucleic acid sequence encoding a polypeptide, specifically GW7 or GS3, that is their function in controlling organ size, in particular organ size. The terms "functional variant" or "functional part" as used herein, for example with reference to SEQ ID NOs: 1, 2, 3 or 4, or SEQ ID NOs: 5, 6, 7 or 8 refers to a variant gene or polypeptide sequence or part of the gene or polypeptide sequence which retains the biological function of the full non-variant GW7 or GS3 sequence, that is regulation of organ size.

Thus, it is understood, as those skilled in the art will appreciate, that the aspects of the invention encompass not only targeting or manipulating a OsGW7 nucleic acid comprising or consisting of SEQ ID NO: 1 or SEQ ID NO: 2, a OsGS3 nucleic acid comprising or consisting of SEQ ID NO: 5 or SEQ ID NO: 6, or a promoter of a OsGW7 or OsGS3 nucleic acid. The aspects of the invention encompass also functional variants of OsGW7 or OsGS3 nucleic acid sequences or their corresponding polypeptides that do not affect the biological activity and function of the resulting protein. Alterations in a nucleic acid sequence which result in the production of a different amino acid at a given site that do however not affect the functional properties of the encoded polypeptide, are well known in the art. For example, a codon for the amino acid alanine, a hydrophobic amino acid, may be substituted by a codon encoding another less hydrophobic residue, such as glycine, or a more hydrophobic residue, such as valine, leucine, or isoleucine. Similarly, changes which result in substitution of one negatively charged residue for another, such as aspartic acid for glutamic acid, or one positively charged residue for another, such as lysine for arginine, can also produce a functionally equivalent product. Each of the proposed modifications is well within the routine skill in the art, as is determination of retention of biological activity of the encoded products. Also encompassed is a variant that is substantially identical, i.e. has only some sequence variations, for example in non-conserved residues, to the wild type sequences as shown herein and is biologically active.

Generally, variants of a particular OsGW7 nucleotide sequence or OsGW7 polypeptide as described herein will have at least about 39%, 40%, 50%, 60%, preferably at least about 75%, 76%, 77%, 78%, 79%, 80%, 81%, 82%, 83%, 84%, 85%, 86%, 87%, 88%, 89%, 90%, 92%, 94%, 95%, 96%, 97%, 98% or 99% or more sequence identity to that particular non-variant nucleotide sequence, as determined by sequence alignment programs described elsewhere herein. variants of a particular OsGS3 nucleotide sequence or OsGW7 polypeptide as described herein will have at least about 39%, 40%, 50%, 60%, preferably at least about 75%, 76%, 77%, 78%, 79%, 80%, 81%, 82%, 83%, 84%, 85%, 86%, 87%, 88%, 89%, 90%, 92%, 94%, 95%, 96%, 97%, 98% or 99% or more sequence identity to that particular non-variant nucleotide sequence, as determined by sequence alignment programs described elsewhere herein.

The variant may differ from the GW7 sequence of SEQ ID NO:3 or the GS3 sequence of SEQ ID NO:7 by insertion, addition, substitution or deletion of one or more amino acid.

Furthermore, the various the aspects of the invention encompass not only a OsGW7 comprising or consisting of SEQ ID NO: 1 or SEQ ID NO: 2, or a polypeptide comprising or consisting of SEQ ID NO: 3 or their functional variants but also homologues of OsGW7 in rice or other plants. Also within the scope of the invention are functional variants of such homologues as defined above.

Furthermore, the various the aspects of the invention encompass not only a OsGS3 comprising or consisting of SEQ ID NO: 5 or SEQ ID NO: 6 respectively or a polypeptide comprising or consisting of SEQ ID NO: 7, or their functional variants, but also homologues of OsGS3 in rice or other plants. Also within the scope of the invention are functional variants of such homologues as defined above.

The term homologue as used herein also designates an OsGW7 and OsGS3 orthologue from other plant species. A homologue of a OsGW7 or OsGS3 polypeptide respectively has, in increasing order of preference, at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least 99% overall sequence identity to the amino acid represented by SEQ ID NO: 3 or 7 respectively. Preferably, overall sequence identity is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, most preferably 90%, 91%, 92%, 93%, 94%, 95%, 96%, 97%, 98%, or at least 99%.

In another embodiment, the homologue of a OsGW7 and OsGS3 nucleic acid sequence respectively has, in increasing order of preference, at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least 99% overall sequence identity to the nucleic acid represented by SEQ ID NO: 1 or 2 or 5 or 6 respectively. Preferably, overall sequence identity is at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, most preferably 90%, 91%, 92%, 93%, 94%, 95%, 96%, 97%, 98%, or at least 99%. The overall sequence identity is determined using a global alignment algorithm known in the art, such as the Needleman Wunsch algorithm in the program GAP (GCG Wisconsin Package, Accelrys).

In one embodiment of the various aspects of the invention, a OsGW7 homologue comprises a conserved domain as discussed above. In one embodiment of the various aspects of the invention, a OsGS3 homologue comprises a conserved domain as discussed above.

In a preferred embodiment, the GW7 or GS3 homologue is from maize, rice, wheat, oilseed rape, sorghum, soybean or lettuce. In one embodiment, the GW7 homologue is selected from SEQ ID NO: 9-59. In one embodiment, the GW7 homologue is selected from SEQ ID NO: 60-113.

Preferred homologues are also shown in FIG. 13 for GW7 and FIG. 14 for GS3. In some embodiments, the GW7 homologue is from a plant that is not *Arabidopsis*. Other GW7 or GS3 polypeptides may be identified using standard methods.

Suitable homologues can be identified by sequence comparisons and identifications of conserved domains. There are predictors in the art that can be used to identify such sequences. The function of the homologue can be identified as described herein and a skilled person would thus be able to confirm the function, for example, the case of GW7, when overexpressed in a plant or, in the case of GS3, knocked out in a plant.

Thus, the nucleotide sequences of the invention and described herein can also be used to isolate corresponding sequences from other organisms, particularly other plants, for example crop plants. In this manner, methods such as PCR, hybridization, and the like can be used to identify such sequences based on their sequence homology to the sequences described herein. Topology of the sequences and the characteristic domains structure can also be considered when identifying and isolating homologues. Sequences may be isolated based on their sequence identity to the entire sequence or to fragments thereof. In hybridization techniques, all or part of a known nucleotide sequence is used as a probe that selectively hybridizes to other corresponding nucleotide sequences present in a population of cloned genomic DNA fragments or cDNA fragments (i.e., genomic or cDNA libraries) from a chosen plant. The hybridization probes may be genomic DNA fragments, cDNA fragments, RNA fragments, or other oligonucleotides, and may be labelled with a detectable group, or any other detectable marker. Thus, for example, probes for hybridization can be made by labelling synthetic oligonucleotides based on the ABA-associated sequences of the invention. Methods for preparation of probes for hybridization and for construction of cDNA and genomic libraries are generally known in the art and are disclosed in Sambrook, et al., (1989) Molecular Cloning: A Library Manual (2d ed., Cold Spring Harbor Laboratory Press, Plainview, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence dependent and will be different in different circumstances. By controlling the stringency of the hybridization and/or washing conditions, target sequences that are 100% complementary to the probe can be identified (homologous probing).

Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Duration of hybridization is generally less than about 24 hours, usually about 4 to 12. Stringent conditions may also be achieved with the addition of destabilizing agents such as formamide.

A plant according to various aspects of the invention, including the genetically engineered, methods and uses described herein may be a monocot or a dicot plant. A monocot plant may, for example, be selected from the families Arecaceae, Amaryllidaceae or Poaceae. For example, the plant may be a cereal crop, such as maize, wheat, rice, barley, oat, sorghum, rye, millet, buckwheat, or a grass crop such as *Lolium* species or *Festuca* species, or a crop such as sugar cane, onion, leek, yam or banana.

A dicot plant may be selected from the families including, but not limited to Asteraceae, Brassicaceae (e.g. *Brassica napus*), Chenopodiaceae, Cucurbitaceae, Leguminosae (Caesalpiniaceae, Aesalpiniaceae Mimosaceae, Papilionaceae or Fabaceae), Malvaceae, Rosaceae or Solanaceae. For example, the plant may be selected from lettuce, sunflower, *Arabidopsis*, broccoli, spinach, water melon, squash, cabbage, tomato, potato, yam, *capsicum*, tobacco, cotton, okra, apple, rose, strawberry, alfalfa, bean, soybean, field (fava) bean, pea, lentil, peanut, chickpea, apricots, pears, peach, grape vine, bell pepper, chilli or citrus species.

Also included are biofuel and bioenergy crops such as rape/canola, sugar cane, sweet sorghum, *Panicum virgatum* (switchgrass), linseed, lupin and willow, poplar, poplar hybrids, *Miscanthus* or gymnosperms, such as loblolly pine. Also included are crops for silage (maize), grazing or fodder (grasses, clover, sanfoin, alfalfa), fibres (e.g. cotton, flax), building materials (e.g. pine, oak), pulping (e.g. poplar), feeder stocks for the chemical industry (e.g. high erucic acid oil seed rape, linseed) and for amenity purposes (e.g. turf grasses for golf courses), ornamentals for public and private gardens (e.g. snapdragon, *petunia*, roses, geranium, *Nicotiana* sp.) and plants and cut flowers for the home (African violets, Begonias, chrysanthemums, geraniums, *Coleus* spider plants, Dracaena, rubber plant).

Preferably, the plant is a crop plant. By crop plant is meant any plant which is grown on a commercial scale for human or animal consumption or use.

Preferred plants are maize, rice, wheat, oilseed rape/canola, sorghum, soybean, sunflower, alfalfa, potato, tomato, tobacco, grape, barley, pea, bean, field bean, lettuce, cotton, sugar cane, sugar beet, broccoli or other vegetable brassicas or poplar.

In a most preferred embodiment, the plant is selected from maize, rice, wheat, oilseed rape, sorghum, soybean or lettuce. In one embodiment, the plant is rice.

In one embodiment, the plant is rice and the function of OsGW7 or OsGW7 and OsGS3 is altered as discussed herein by recombinant methods. In another embodiment, an exogenous OsGW7 nucleic acid is expressed in a second plant that is not rice but is of another species. Thus, all aspects of the invention, including the transgenic plants and methods of the invention, also extend to plants other than rice the function of GW7 or GW7 and GS3 is altered, for example which express a nucleic acid construct comprising a OsGW7 nucleic acid sequence or express a nucleic acid construct comprising an endogenous GW7 nucleic acid sequence.

In another embodiment, the plant is maize and expresses a nucleic acid construct comprising a maize GW7 nucleic acid sequence. In another embodiment, the plant is wheat and expresses a nucleic acid construct comprising a wheat GW7 nucleic acid sequence. In another embodiment, the plant is oilseed rape and expresses a nucleic acid construct comprising a oilseed rape GW7 nucleic acid sequence. In another embodiment, the plant is sorghum and expresses a nucleic acid construct comprising a sorghum GW7 nucleic acid sequence. In another embodiment, the plant is soybean and expresses a nucleic acid construct comprising a soybean GW7 nucleic acid sequence. In another embodiment, the plant is lettuce and expresses a nucleic acid construct comprising a lettuce GW7 nucleic acid sequence.

The term "plant" as used herein encompasses whole plants, ancestors and progeny of the plants and plant parts, including seeds, fruit, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" as described herein relates to yield-related traits and may relate to vegetative biomass (root and/or shoot biomass), to reproductive organs, and/or to propagules (such as seeds) of that plant. Thus, according to the invention, the term yield refers to organ size, in particular seed size and can be measured by assessing seed size or seed weight or cotyledon size.

The terms "increase", "improve" or "enhance" are interchangeable. Yield or organ size for example is increased by at least a 2%, 3%, 4%, 5%, 6%, 7%, 8%, 9% or 10%, preferably at least 15% or 20%, more preferably 25%, 30%, 35%, 40% or 50% or more in comparison to a control plant.

Plants according to the various aspects of the invention have longer and more slender leaves, seeds, grain or other organs compared to a control plant. A control plant as used herein according to all of the aspects of the invention is a plant which has not been engineered modified according to the methods of the invention, preferably a plant of the same species. In one embodiment, the plant is a wild type plant. The control plant can be a naturally occurring variety which does not comprise the beneficial allele. The phenotype of a plant organ as used herein specifically refers to the size of a plant organ which is increased as described herein.

In another aspect, the invention relates to an isolated nucleic acid comprising a OsGW7 nucleic acid sequence comprising or consisting of SEQ ID NO: 1 or 2. In another aspect, the invention relates to vector comprising an isolated nucleic acid comprising a OsGW7 nucleic acid sequence comprising or consisting of SEQ ID NO: 1 or 2. In another aspect, the invention relates to a host cell comprising said isolated nucleic acid or vector. Said host cell can be a bacterial or a plant cell. Also within the scope of the invention is a culture medium, composition or kit comprising such a cell.

In another aspect, the invention relates to the use of a nucleic acid comprising or consisting of SEQ ID NO: 1, 2 or 4 a homolog or functional variant thereof or a vector as described above in altering the phenotype of a leaf, seed, grain or another plant organ. In another aspect, the invention relates to use of a nucleic acid comprising or consisting of SEQ ID NO: 5, 6 or 8 a homolog or functional variant thereof or a vector comprising said nucleic acid as described above in altering the phenotype of a leaf, seed, grain or another plant organ. In particular, organ size is increased.

In another aspect, the invention relates to the use of a nucleic acid comprising or consisting of SEQ ID NO: 1, 2 or 4 a homolog or functional variant thereof or a vector as described above in increasing yield and/or grain quality. In another aspect, the invention relates to use of a nucleic acid comprising or consisting of SEQ ID NO: 5, 6 or 8 a homolog or functional variant thereof or a vector comprising said nucleic acid as described above in increasing yield and/or grain quality.

In another aspect, the invention relates to a method for altering the phenotype of a plant organ said method comprising increasing the expression of a nucleic acid sequence encoding a GW7 polypeptide or increasing the activity of a GW7 polypeptide.

In one embodiment, said method comprises introducing and expressing in said plant a nucleic acid construct comprising a nucleic acid as defined in SEQ ID NO: 1 or 2, a homolog or a functional variant thereof. In another embodiment, said method comprises introducing a mutation in the promoter or coding region of a GW7 nucleic acid sequence as defined in SEQ ID NO: 1 or 2, a homolog or functional variant thereof. These methods can also additionally comprise reducing or abolishing the expression of a nucleic acid sequence encoding a GS3 polypeptide or the activity of a GS3 polypeptide. Said phenotype can be altered to increase yield and/or grain quality.

In another aspect, the invention relates to a method for producing a genetically engineered plant said method comprising increasing the expression of a nucleic acid sequence as defined in SEQ ID NO: 1 or 2 or a functional variant, for example rice variant, thereof or increasing the activity of a GW7 polypeptide as defined in SEQ ID NO: 3, a homolog or a functional rice variant thereof or comprising introducing a mutation in the promoter or coding region of a GW7 nucleic acid sequence as defined in SEQ ID NO: 1 or 2, a homologue or functional variant thereof. The method can also additionally comprise reducing or abolishing the expression of a nucleic acid sequence encoding a GS3 polypeptide or the activity of a GS3 polypeptide.

According to these methods a wild type plant may be targeted to alter GW7 expression or GW7 function and also GS3 expression or GS3 function, for example by simultaneous transformation with suitable vectors. Alternatively, the method may comprise the following steps
  a) increasing GW7 expression or GW7 function in a first plant;
  b) knocking out or knocking down GS3 function in a second plant and
  c) crossing plants regenerated from said first plant with plants regenerated from said second plant.

In another embodiment, the method may comprise the following steps
  a) increasing GW7 expression or GW7 function in a first plant;
  b) crossing plants regenerated from said first plant with a second plant wherein GS3 is knocked out or down
  c) regenerating plants.

For example, a plant which has been generated using genetic engineering methods to increase GW7 expression or GW7 function to can be crossed with a naturally occurring variety which has reduced expression of function of GS3.

In another embodiment, the method may comprise the following steps
  a) knocking down GS3 expression or reducing GS3 function in a first plant;

b) crossing plants regenerated from said first plant with a second plant wherein GW7 expression or GW7 function is increased c) regenerating plants.

For example, a plant which has been generated using genetic engineering methods to create a GS3 loss of function mutant to can be crossed with a naturally occurring variety which has increases GW7 expression or GW function.

Plants obtained or obtainable by the methods of the invention are also within the scope of the invention.

In the methods described here, plants can be regenerated from plants transformed or genetically altered as described above. In additional steps, the phenotype, specifically the organ phenotype can be analysed by known methods to detect plants with increased organ size and yield. Organ size or yield can also be compared to that of a control plant in an additional step.

Transformation methods that can be used in the methods of the invention are known in the art. The nucleic acid sequence is introduced into said plant through a process called transformation. The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plants is now a routine technique in many species. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts, electroporation of protoplasts, microinjection into plant material, DNA or RNA-coated particle bombardment, infection with (non-integrative) viruses and the like. Transgenic plants, including transgenic crop plants, are preferably produced via *Agrobacterium tumefaciens* mediated transformation.

To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility is growing the seeds, if appropriate after sterilization, on agar plates using a suitable selection agent so that only the transformed seeds can grow into plants. Alternatively, the transformed plants are screened for the presence of a selectable marker such as the ones described above. Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

In the foregoing, plants are described that have been genetically engineered using human intervention to alter expression or function of GW7/GW7 and, in some embodiments, also of GS3/GS3.

Further aspects of the invention relate to methods for identifying and/or selecting a rice plant or a rice germplasm that has a phenotype selected from increased length of grain or other organs and/or increased slenderness of grain, plants identified by such methods, molecular markers, compositions and related uses.

Specific genetic loci correlating with particular phenotypes can be mapped in a plant's genome by the process of linkage mapping, where the strength of association between a genetic marker locus and the locus determining a phenotypic trait of interest is a function of the physical proximity (the genetic "linkage") on the chromosome of the marker locus and the trait locus. This allows the plant breeder to rapidly select and identify plants with the desired phenotype by detecting markers that show a statistically significant probability of co-segregation with a desired phenotype. Genetic markers that are within a gene that confers the desired trait, or indeed are based on the actual polymorphism that causes the desired trait, are in effect 100% linked and therefore 100% accurate in their predictive or diagnostic power. The invention is an example of such a 100% linked, directly causative marker.

The invention is therefore directed to methods for identifying and selecting rice plants with enhanced grain quality through the analysis of the genotype by assessing the presence of markers. According to the invention, the identification of a haplotype that is associated with enhanced grain quality in rice allows selection for resistance based solely on the genetic composition of the progeny.

The invention thus provides methods for Marker-assisted selection (MAS) to identify/select a rice plant with enhanced grain quality and which has the haplotype described herein. MAS is a process by which phenotypes are selected based on marker genotypes. This is useful in Marker-assisted breeding (MAB) and the invention also involves methods for MAB as described herein.

Detection of the presence or absence of particular alleles at each of the 5' polymorphic locus allows identifying and selecting a rice plant with better grain quality. This invention thus provides a method for molecular marker assisted selective breeding of rice.

The desirable allele at the locus described herein can be selected for as part of a breeding program in order to generate plants that carry desirable traits. An exemplary embodiment of a method for generating such plants includes the transfer by chromosomal recombination and introgression of nucleic acid sequences from plants that have desirable genetic information into plants that do not by crossing the plants.

Desirable loci can be introgressed, for example into commercially available plant varieties, using marker-assisted selection (MAS) or marker-assisted breeding (MAB). MAS and MAB involves the use of one or more of the molecular markers for the identification and selection of those progeny plants that contain one or more loci that encode the desired traits as described herein. Such identification and selection can be based on selection of informative markers that are associated with desired traits.

In general, MAS uses polymorphic markers that have been identified as having a significant likelihood of co-segregation with a phenotype, such as better grain quality. Such markers are presumed to map near a gene or genes that give the plant its better grain quality phenotype, and are considered indicators for the desired trait, or markers. Plants are tested for the presence of a desired allele in the marker, and plants containing a desired genotype at one or more loci are expected to transfer the desired genotype, along with a desired phenotype, to their progeny. Thus, plants with enhanced grain quality can be selected for by detecting one or more marker alleles, and in addition, progeny plants derived from those plants can also be selected. Hence, a plant containing a desired genotype in a given chromosomal region (i.e. a genotype associated with enhanced grain quality) is obtained and then crossed to another plant.

The progeny of such a cross can then be evaluated genotypically using one or more markers and the progeny plants with the same genotype in a given chromosomal region are then selected as having enhanced grain quality.

As shown in the examples, the inventors have identified rice lines which produce long and slender grains of excellent quality. The have shown that a rice grain quality quantitative trait locus qGW7 reflects allelic variation for GW7. The presence of a semidominant GW7$^{TFA}$ allele from tropical *japonica* rice was associated with higher grain quality without yield penalty. Sequence analysis revealed that a set of 18 SNPs (single nucleotide polymorphisms) and 9 indels (short insertion deletion polymorphisms) in the promoter region of GW7 was differentiated between TFA lines that showed the beneficial grain phenotype and HJX74 lines that did not have the beneficial grain phenotype. The inventors have thus shown that the polymorphism in the 5'-UTR of GW7 contribute to grain phenotype in rice, specifically better grain quality, and that the polymorphism in the gene promoter region is the functional variations responsible for the observed variations in gene expression and grain quality. The favourable allele of GW7 which shows the polymorphism is thus a valuable genetic resource for improving rice grain quality for example as a genetic marker in marker assisted breeding.

As explained herein, the presence or absence of the favourable allele that confers enhanced grain quality in rice can be detected using markers. As further explained herein, the marker can be a molecular marker. Markers can thus be used in the methods of the invention to identify the favourable genotype.

A "marker" is a nucleotide sequence or encoded product thereof (e.g., a protein) used as a point of reference. A marker associated with enhanced grain quality in rice is a marker whose presence or absence can be used to predict whether and/or to what extend a plant will display a grain phenotype.

A marker that demonstrates linkage with a locus affecting a desired phenotypic trait provides a useful tool for the selection of the trait in a plant population. This is particularly true where the phenotype is hard to assay, e.g. many disease resistance traits, or, occurs at a late stage in plant development, e.g. kernel characteristics. Since DNA marker assays are less laborious and take up less physical space than field phenotyping, much larger populations can be assayed, increasing the chances of finding a recombinant with the target segment from the donor line moved to the recipient line. The closer the linkage, the more useful the marker, as recombination is less likely to occur between the marker and the gene causing the trait, which can result in false positives. Having flanking markers decreases the chances that false positive selection will occur as a double recombination event would be needed. The ideal situation is to have a marker in the gene itself, so that recombination cannot occur between the marker and the gene.

For markers to be useful at detecting recombinations, they need to detect differences, or polymorphisms, within the population being monitored. A "polymorphism" is a variation in the DNA that is too common to be due merely to new mutation. A polymorphism must have a frequency of at least 1% in a population. A polymorphism can be a single nucleotide polymorphism, or SNP, or an insertion/deletion polymorphism, also referred to herein as an "InDel".

For molecular markers, differences are detected at the DNA level due to polynucleotide sequence differences (e.g. SSRs, RFLPs, FLPs, and SNPs). The genomic variability can be of any origin, for example, insertions, deletions, duplications, repetitive elements, point mutations, recombination events, or the presence and sequence of transposable elements. Molecular markers can be derived from genomic or expressed nucleic acids (e.g., ESTs) and can also refer to nucleic acids used as probes or primer pairs capable of amplifying sequence fragments via the use of PCR-based methods. The polymorphisms are not limited to single nucleotide polymorphisms (SNPs), but also include InDels, CAPS, SSRs, and VNTRs (variable number of tandem repeats).

Markers corresponding to genetic polymorphisms between members of a population can be detected by methods well-established in the art. These include, e.g., DNA sequencing, PCR-based sequence specific amplification methods, detection of restriction fragment length polymorphisms (RFLP), detection of isozyme markers, detection of polynucleotide polymorphisms by allele specific hybridization (ASH), detection of amplified variable sequences of the plant genome, detection of self-sustained sequence replication, detection of simple sequence repeats (SSRs), detection of single nucleotide polymorphisms (SNPs), or detection of amplified fragment length polymorphisms (AFLPs). Well established methods are also known for the detection of expressed sequence tags (ESTs) and SSR markers derived from EST sequences and randomly amplified polymorphic DNA (RAPD).

A "molecular marker probe" as used herein is a nucleic acid sequence or molecule that can be used to identify the presence of a marker locus, e.g., a nucleic acid probe that is complementary to a marker locus sequence. Alternatively, in some aspects, a marker probe refers to a probe of any type that is able to distinguish (i.e., genotype) the particular allele that is present at a marker locus. Nucleic acids are "complementary" when they specifically hybridize in solution, e.g., according to Watson-Crick base pairing rules. Some of the markers described herein are also referred to as hybridization markers when located on an InDel region, such as the non-collinear region described herein. This is because the insertion region is, by definition, a polymorphism vis-a-vis a plant without the insertion. Thus, the marker need only indicate whether the InDel region is present or absent. Any suitable marker detection technology may be used to identify such a hybridization marker, e.g. SNP technology is used in the examples provided herein.

SNP markers detect single base pair nucleotide substitutions. SNPs can be assayed at a high level of throughput. Several methods are available for SNP genotyping, including but not limited to, hybridization, primer extension, oligonucleotide ligation, nuclease cleavage, minisequencing and coded spheres. A wide range of commercially available technologies utilize these and other methods to interrogate SNPs including Masscode® (Qiagen), Invader® (Third Wave Technologies) and Invader Plus®, Snapshot® (Applied Biosystems), Taqman® (Applied Biosystems), KASP and Beadarrays® (Illumina).

In one aspect, the invention therefore relates to a method for identifying and/or selecting a rice plant of a rice germplasm that has a phenotype selected from increased length of grain or other organs and increased slenderness grain or other organs, comprising detecting in the rice plant or the rice germplasm at least one polymorphism within a marker locus that is associated with said phenotype of said rice plant or said rice germplasm, wherein said marker locus is genetically linked with a chromosomal region comprising nucleic acid sequence SEQ ID NO:1, and wherein the rice plant or a progeny thereof or the rice germplasm or a progeny thereof is selected. Preferably, said marker locus comprises a 5' UTR GW7 allele from rice which comprises a mutation that increases expression of GW7, for example a deletion at position −103~−115 and/or an insertion at −144~−145 as elsewhere described and shown in table 3.

The wild type 5' UTR sequence that does not have the beneficial mutation is shown in SEQ ID NO: 4. Mutations that are found in the marker locus are shown in table 3. For example, the marker locus comprises all of the mutations shown in table 3.

In one embodiment, said method further comprises introgressing said chromosomal region comprising at least one of said polymorphisms into a second rice plant or a second rice germplasm to produce an introgressed rice plant or introgressed rice germplasm. In one embodiment, said second rice plant comprises a gs3 allele.

The term "introgression" refers to the transmission of a desired allele of a genetic locus from one genetic background to another. For example, introgression of a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. Offspring comprising the desired allele can be repeatedly backcrossed to a line having a desired genetic background and selected for the desired allele, to result in the allele becoming fixed in a selected genetic background. For example, the chromosome locus described herein may be introgressed into a recurrent parent. The recurrent parent line with the introgressed gene or locus then has enhanced grain quality. The process of "introgressing" is often referred to as "backcrossing" when the process is repeated two or more times.

The term "rice plant" includes: whole rice plants, rice germplasm, rice plant cells, rice plant protoplast, rice plant cell or rice tissue cultures from which rice plants can be regenerated, rice plant calli, and rice plant cells that are intact in rice plants or parts of maize plants, such as rice grains, flowers, cotyledons, leaves, stems, rootsand the like. The rice can be an inbred line, or a rice hybrid such as a rice single cross hybrid.

In another aspect, the invention relates to method of identifying alleles in rice plants or rice germplasm that are associated with improved grain quality and/or increased yield, the method comprising:
a. obtaining a population of rice plants, wherein one or more plants exhibit improved grain quality;
b. evaluating allelic variations with respect to the polynucleotide sequence encoding a protein comprising a polypeptide comprising SEQ ID NO: 3 or in the genomic region that regulates the expression of the polynucleotide encoding the protein;
c. obtaining phenotypic values of improved grain quality for a plurality of rice plants in the population;
d. associating the allelic variations in the genomic region associated with the polynucleotide with the phenotype; and
e. identifying the alleles that are associated with improved grain quality.

In one aspect, the invention relates to a rice plant identified, produced and/or selected by a method according describe above.

When referring to the detection of a haplotype, that is the beneficial allele described herein, all aspects of the invention, including the methods of the invention relate to detecting a haplotype present in a homozygous or heterozygous state.

In another aspect, the invention relates to a recombined DNA segment comprising a 5' UTR GW7 allele from rice which comprises a mutation that increases expression of GW7. Preferably, said mutation is in the OsSPL16 binding site or in the vicinity thereof. For example, it can be in close proximity to the GTAC motif in the GW7$^{TFA}$ allele. In one embodiment, the 5' UTR comprises an 11 bp deletion at position −103 to −115 and a 18 bp insertion between residues −144 to −145. In one embodiment, said DNA segment is comprised within a cell. In one embodiment, said allele comprises all of the mutations as set out in table 3. In one embodiment, said DNA segment is comprised within a grain. In one embodiment, said DNA segment is comprised within a rice plant.

In another aspect, the invention relates to a rice plant comprising a GW7 allele wherein said allele confers increased grain length and increased grain slenderness.

In another aspect, the invention relates to an isolated nucleic acid comprising SEQ ID NO:x-x as shown below and in table 6. These nucleic acids can be used as a primer pairs to amplify the region of interest.

```
M13 Forward
                                         SEQ ID NO: 119
gCTTATTTCAACCCCCCCTCTC Reverse
                                         SEQ ID NO: 120
gACgCgTgAgATgAgATgTgg
```

-continued

M14 Forward

CCACATCTCATCTCACgCgTC
SEQ ID NO: 121

Reverse

ATCCAACTgCAgAgCAgCTC
SEQ ID NO: 122

In another aspect, the invention relates to a kit or composition for identifying and/or selecting a rice plant with enhanced grain quality comprising a primer pair as shown in table 6, preferably comprising two or more of SEQ ID NO. 119 to SEQ ID NO. 122.

Other suitable primers can be designed by a person skilled in the art.

The invention also relates to a composition comprising an amplification primer pair capable of amplifying a rice nucleic acid to generate a rice marker amplicon. The presence or absence of the polymorphism can be detected by methods known in the art, such as PCR amplification followed by sequencing, such as SNP mini-sequencing.

Other methods that can be used to detect SNPs are known in the art and described herein. These include, but are not limited to fluorescent detection of SNP-specific hybridization probes on PCR products such as Taqman® or Molecular Beacons. Other strategies such as Sequenom homogeneous Mass Extend (hME) and iPLEX genotyping systems involve MALDI-TOF mass spectrophotometry of SNP-specific PCR primer extension products.

In one embodiment, Kompetitive Allele Specific PCR (KASP) genotyping is used. This requires the presence of 1) a purified DNA sample, 2) two allele-specific forward primers, and 3) a common reverse primer. KASP is a SNP genotyping system FRET (Fluorescent Resonance Energy Transfer). FRET allows for the detection of SNP's without the need for a separation step. Coupled with the power of competitive allele specific PCR, the KASP is a well described system for determination of SNP or insertion/deletion genotypes.

The invention also relates to a method of increasing the frequency of a better grain quality phenotype in a population of rice plants comprising:
a. providing a first population of rice plants;
b. detecting the presence of a genetic marker in the 5' UTR of GW7 that is associated with a better grain quality trait;
c. selecting one or more corn plants exhibiting the better grain quality genotype from the first population of rice plants; and
d. producing an offspring population from the one or more selected rice plants such that the better grain quality phenotype occurs more frequently in the offspring population as compared to the first population.

In accordance with another aspect of the invention the invention, novel rice varieties may be created by crossing plants of the invention followed by generations of selection as desired and inbreeding for development of uniform lines. New varieties may also be created by crossing with any second plant. In selecting such a second plant to cross for the purpose of developing novel lines, it may be desired to choose those plants which either themselves exhibit one or more selected desirable characteristics or which exhibit the desired characteristic(s) when in hybrid combination. Once initial crosses have been made, inbreeding and selection take place to produce new varieties. For development of a uniform line, often five or more generations of selfing and selection are typically involved.

Uniform lines of new varieties may also be developed by way of doubled-haploids. This technique allows the creation of true breeding lines without the need for multiple generations of selfing and selection. In this manner true breeding lines can be produced in as little as one generation. Haploid embryos may be produced from microspores, pollen, anther cultures, or ovary cultures. The haploid embryos may then be doubled autonomously, or by chemical treatments (e.g. colchicine treatment). Alternatively, haploid embryos may be grown into haploid plants and treated to induce chromosome doubling. In either case, fertile homozygous plants are obtained. In accordance with the invention, any of such techniques may be used in connection with a plant of the present invention and progeny thereof to achieve a homozygous line.

Backcrossing can also be used to improve an inbred plant. Backcrossing transfers a specific desirable trait, such as elevated glucoraphanin, from one inbred or non-inbred source to a variety that lacks that trait. This can be accomplished, for example, by first crossing a parent (A) (recurrent parent) to a donor inbred (non-recurrent parent), which carries the appropriate locus or loci for the trait in question. The progeny of this cross are then mated back to the recurrent parent (A) followed by selection in the resultant progeny for the desired trait to be transferred from the non-recurrent parent. After five or more backcross generations with selection for the desired trait, the progeny are heterozygous for loci controlling the characteristic being transferred, but are like the first parent for most or almost all other loci. The last backcross generation would be selfed to give pure breeding progeny for the trait being transferred.

The selection of a suitable recurrent parent is an important step for a successful backcrossing procedure. The goal of a backcross protocol is to alter or substitute a single trait or characteristic in the original variety. To accomplish this, a single locus of the recurrent variety is modified or substituted with the desired locus from the nonrecurrent parent, while retaining essentially all of the rest of the desired genetic, and therefore the desired physiological and morphological constitution of the original variety. The choice of the particular nonrecurrent parent will depend on the purpose of the backcross; one of the major purposes is to add some commercially desirable trait to the plant. The exact backcrossing protocol will depend on the characteristic or trait being altered to determine an appropriate testing protocol. Although backcrossing methods are simplified when the characteristic being transferred is a dominant allele, a recessive allele may also be transferred. It may be necessary to introduce a test of the progeny to determine if the desired characteristic has been successfully transferred.

In the methods above, detection can be carried out using the methods and primers described elsewhere herein. Also within the scope of the invention is a plant or plant cell produced by the methods described above.

The various aspects of the invention described herein clearly extend to any plant cell or any plant produced, obtained or obtainable by any of the methods described herein, including genetically engineered plants, for example transgenic plants and and non-genetically engineered plants, and to all plant parts and propagules thereof unless otherwise specified. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also extends to harvestable parts of a plant of the invention as described above such as, but not limited to grains, seeds, leaves, fruits, flowers, stems, roots, rhizomes, tubers and bulbs. The invention furthermore relates to products derived, preferably directly derived, from a harvestable part of such a plant, such as dry pellets or powders, oil, fat and fatty acids, starch or proteins. The invention also relates to food products and food supplements comprising the plant of the invention or parts thereof.

While the foregoing disclosure provides a general description of the subject matter encompassed within the scope of the present invention, including methods, as well as the best mode thereof, of making and using this invention, the following examples are provided to further enable those skilled in the art to practice this invention and to provide a complete written description thereof. However, those skilled in the art will appreciate that the specifics of these examples should not be read as limiting on the invention, the scope of which should be apprehended from the claims and equivalents thereof appended to this disclosure. Various further aspects and embodiments of the present invention will be apparent to those skilled in the art in view of the present disclosure.

All documents mentioned in this specification are incorporated herein by reference in their entirety, including accession numbers for nucleic acid and amino acid sequences, for example those shown the tables herein.

"and/or" where used herein is to be taken as specific disclosure of each of the multiple specified features or components with or without the other at each combination unless otherwise dictated. For example "A, B and/or C" is to be taken as specific disclosure of each of (i) A, (ii) B, (iii) C, (iv) A and B, (v) B and C or (vi) A and B and C, just as if each is set out individually herein.

Unless context dictates otherwise, the descriptions and definitions of the features set out above are not limited to any particular aspect or embodiment of the invention and apply equally to all aspects and embodiments which are described.

The invention is further described in the following non-limiting examples.

EXAMPLES

Methods

Plant Materials and Growing Conditions.

The NIL-GW7$^{TFA}$ plants were generated by back-crossing the hybrid TFA×HJX74 and further six times with HJX74. Contrasting allelic combinations of the qGW7 and qGS3 loci were assembled in the HJX74 background using NIL-GS3-GW7$^{TFA}$ and NIL-gs3-gw7$^{HJX74}$ plants[12]. Details of the germplasm used for the sequence diversity analysis have been described elsewhere[12], 24. Field-grown NILs plants were raised in a rice paddy at an inter-plant spacing of 20 cm during the standard growing season at three experimental stations, located in Lingshui (Hainan Province), Hefei (Anhui Province) and Beijing. The primer sequences for the genotyping assays are provided in Table 6.

Positional Cloning of qGW7.

Fine-scale mapping of qGW7 was based on 4,500 BC3F2 plants bred from the backcross between TFA and an indica variety HJX74 (HJX74 as the recurrent parent). The genomic DNA sequence in the GW7 candidate region was compared between TFA and HJX74. A list of markers used for QTL analysis and positional cloning is given in Table 6.

Transgene Constructs.

The GW7 coding sequence and the 5'-UTR regions lying 2 kbp upstream of the transcription start site and 1 kbp downstream of the termination site were amplified from TFA, then inserted into the pCAMBIA1300 vector (CAMBIA, Canberra, Australia) to generate a pGW7$^{TFA}$::GW7$^{TFA}$ expression cassette. A 406 bp cDNA fragment of GW7 was amplified from TFA, and then was used to construct the pActin::RNAi-GW7$^{TFA}$ transgene. To construct pUbi:: GW7$^{HJX74}$ vector, the HJX74 GW7 cDNA was amplified and inserted into the vector pUbi::nos[24]. To construct pGW7$^{HJX74}$::GUS, 2 kbp DNA fragment of HJX74 GW7 promoter sequence was amplified and then inserted into the vector pCAMBIA1301-GUS-nos[12]. Transgenic plants were generated by *Agrobacterium*-mediated transformation[27]. Relevant PCR primer sequences are given in Table 7.

qRT-PCR Analysis.

Total RNA was extracted from plant tissues using TRIzol reagent (Invitrogen, New York, USA), then treated with RNase-free DNase I (Invitrogen, New York, USA) according to the manufacturer's protocol. To provide qRT-PCR template the resulting RNA was reverse transcribed using an M-MLV Reverse Transcriptase kit (Promega, Wis., USA). qRT-PCR was performed as described previously[28], each qRT-PCR assay was replicated at least three time with three independent RNA preparations, and rice actin3 was used as a reference. Relevant PCR primer sequences are given in Table 7.

ChIP-PCR Assays.

A 2~3 g aliquot of 4-week-old transgenic pUbi..myc-GW7 rice plants was fixed by formaldehyde cross-linking and subjected to a ChIP assay based on an anti-myc antibody (Santa Cruz Biotechnology, Santa Cruz, USA) as described previously[29]. The enrichment of DNA fragments was determined using a qRT-PCR analysis performed on three biological replicates. The relevant primer sequences are shown in Table 8.

EMSA Assays.

The OsSPL16/GW8 coding sequence was amplified from TFA, then cloned into the pMALTM-c2X vector (New England Biolabs, Ipswich, USA). MBP and the MBP-GW7 fusion protein were purified following the manufacturer's protocol. DNA probes were amplified and labeled using a biotin label kit (Invitrogen, New York, USA). DNA gel-shift assays were performed using a LightShift Chemiluminescent EMSA Kit (Thermo Fisher Scientific, Waltham, USA). The relevant primer sequences are given in Table 9.

Transactivation Analysis.

Transactivation analysis in rice protoplasts were performed as described elsewhere[30]. The 2-kbp DNA fragment of GW7 promoter were amplified from either TFA or HJX74, then used to generate reporter plasmids that contained the GW7 promoter and LUC. The full-length cDNA of OsSPL16 was amplified from HJX74 and fused to GAL4BD, and then inserted into pRT107 to generate effector plasmid pRTBD-OsSPL16. LUC assays were performed as described elsewhere[30]. Relevant PCR primer sequences are given in Table 6.

BiFC Assays.

The GW7 coding sequence was amplified and inserted into pSY735[31] vector, and the full-length cDNAs of OsTON1b and OsTON2 were amplified and subcloned into pSY736[31] vectors. *Arabidopsis* protoplasts were prepared, transfected and visualized as described elsewhere[24]. Relevant PCR primer sequences are given in Table 6.

Yeast One-Hybrid Assays.

The HJX74 OsSPL16 cDNA was inserted into the unique EcoRI and XhoI sites of pB42AD (Takara Bio Inc. Otsu, Japan). The 0.5 kbp and 1.0 kbp DNA fragments of GW7 promoters were amplified from either TFA or HJX74, and then subcloned into the pLacZi2p[32] vector to drive LacZ reporter genes. The constructs were transformed into yeast strain EGY48, the experimental procedures were performed according to the manufacturer's user guide. β-galactosidase activity was assayed by hydrolysis of o-nitrophenyl-beta-D-galactopyranoside (ONPG) and measuring the absorbency of the released o-nitrophenyl (ONP) compound in a spectrophotometer at 415 nm. Relevant PCR primer sequences are given in Table 6.

Yeast Two-Hybrid Assay.

Yeast two-hybrid assays were performed as described elsewhere[24]. The full length cDNAs of OsTON1b and OsTON2 were amplified and then subcloned into pGBKT7 (Takara Bio Inc. Otsu, Japan), and the full-length GW7 coding sequence as well as its N-terminal and C-terminal truncated deletions were inserted into pGADT7 (Takara Bio Inc. Otsu, Japan). The vectors were then transformed into yeast strain AH109. The GW7 protein was used as a bait to screen a cDNA library prepared from equal amount of Poly-A$^+$ RNA of various rice samples (seedlings, roots, leaves, stems and young panicles etc.). Experimental procedures for screening and plasmid isolation were performed according to the manufacturer's user guide. The sequences of primers are provided in Table 7.

Discussion

Shanyou63 is the most widely grown hybrid variety in China. Its parents are restorer line Mnghui63 (MH63) and CMS (cytoplasmic male sterility) line Zhenshan97A (ZS97A). Its grains are short and wide, and are considered to be of only mediocre quality (FIG. 1a, b). In contrast, the hybrid formed by crossing MH63 and a newly developed CMS line TaifengA (TFA), produces long and slender grains with the excellent quality (FIGS. 1a, b and 2). The two hybrids differ only marginally from one another with respect to the number of tillers per plant, the number of grains per panicle, the weight of 1,000-grains and the overall grain yield per plant (FIG. 5). To investigate the genetic basis of improved grain quality, an F2 population of 400 individuals developed from a cross between two maintainer lines (ZS97B and TFB), and was used to identify two major grain width QTL, termed qGW4 and qGW7, along with three major grain length QTL (qGL3, qGL7 and qGL12) (FIG. 1c). Co-segregation in the BC1F2 generation derived from the backcross between TFB and ZS97B (ZS97B as the recurrent parent) suggested that qGL3 was mapped to the same locus as qGS3 which regulates grain weight and grain length[14], sequence comparison of the GS3 gene revealed that TFA and TFB had the same loss-of-function gs3 allele as MH63[14] (Data not shown). Both qGW7 and qGL7 mapped to the same region of chromosome 7 (FIG. 1c). A genetic analysis of 200 BC2F2 progeny suggested that a semidominant qGW7 allele from the TFB was responsible for grain slenderness (FIG. 6).

Fine-scale mapping of qGW7 based on the segregation pattern of 4,500 BC3F2 plants bred from the backcross between TFA (the donor parent) and the high-yielding indica variety HJX74 (the recurrent parent) allowed the placement of the locus to be confined to an ~20 kbp segment flanked by markers M1 and M10 (FIG. 1d). A progeny test of homozygous segregants further narrowed this to an ~2.6 kbp region flanked by markers S5 and S6 (FIG. 1e); this stretch of DNA harbors the promoter region and exon 1 of the gene LOC_Os07g41200 (FIG. 1f), hereafter referred to as GW7. The GW7 gene encodes a homolog of the *Arabidopsis thaliana* TONNEAU1 (TON1[15]) recruiting motif proteins (TRM[16]) (FIG. 7), which shares homology with C-terminal motifs of the human centrosomal proteins CEP350 and CAP350[17] (FIG. 8). Sequence analysis revealed that a set of 18 SNPs (single nucleotide polymorphisms) and 9 indels (short insertion deletion polymorphisms) in the promoter region of GW7 was differentiated between TFA and HJX74 (FIG. 1f and Table 3).

The near-isogenic line NIL-GW7$^{TFA}$ is homozygous for the TFA qGW7 allele in a HJX74 background, whereas NIL-gw7$^{HJX74}$ is homozygous for the HJX74 allele. Different transcriptional levels of GW7 between NIL-gw7$^{HJX74}$ and NIL-GW7$^{TFA}$ were compared in various organs during the vegetative growth, reproductive development[18, 19], and developing rice endosperms (FIG. 2a). qRT-PCR analysis identified differences in GW7 transcript abundance between NIL-GW7$^{TFA}$ and NIL-gw7$^{HJX74}$ with the gene being transcribed more strongly in NIL-GW7$^{TFA}$ than in NIL-gw7$^{HJX74}$ in the stages of developing panicles (FIG. 2a) and in the middle stages of developing rice endosperm. The transgenic rice plants carrying a pGW7$^{HJX74}$::GUS construct showed a strong GUS signal in the spikelet hulls (FIG. 2b). The transgenic NIL-gw7$^{HJX74}$ plants expressing the TFA GW7 cDNA driven by its native promoter produced slender grains than those formed by NIL-gw7$^{HJX74}$ plants (FIG. 2c). Conversely, NIL-GW7$^{TFA}$ plants which had been RNAi-silenced for GW7 formed shorter and wider grains than those formed by NIL-GW7$^{TFA}$ plants (FIG. 2c). Transgenic NIL-gw7$^{HJX74}$ plants, in which the HJX74 GW7 cDNA was constitutively overexpressed, formed grains which were substantially narrower and longer than those formed by non-transgenic NIL-GW7$^{TFA}$ plants (FIG. 2c). These results indicate that up-regulation of GW7 promotes the formation of more slender grains.

Prior to fertilization, the spikelet hulls formed by NIL-gw7$^{HJX74}$ plants were shorter and wider than those formed by NIL-GW7$^{TFA}$ ones (FIG. 2d). An inspection of palea and lemma transverse sections revealed that cell number in the inner parenchyma cell layer of NIL-GW7$^{TFA}$ was less than that in NIL-gw7$^{HJX74}$ (FIG. 2e-2g). The average width of NIL-Gw7$^{TFA}$ outer epidermal cells was wider than that of NIL-gw7$^{HJX74}$ cells (FIG. 2h), but there was an ~6.4% decrease in transverse cell proliferation in NIL-GW7$^{TFA}$ spikelet hulls (FIG. 2i), indicating that the reduced grain width in NIL-GW7$^{TFA}$ is resulted from a decreased cell division in the transverse direction. Conversely, the average length of the NIL-GW7$^{TFA}$ outer epidermal cells was indistinguishable from that of NIL-gw7$^{HJX74}$ cells (FIG. 2h), whereas there was an ~6.5% increase in longitudinal cell proliferation in NIL-GW7$^{TFA}$ spikelet hulls (FIG. 2i). The implication was that the formation of slender grains resulted from an increased cell division in the longitudinal direction and decreased cell division in the transverse direction. Thus GW7 appears to regulate grain shape by changing cell division patterns.

We next screened for GW7-interacting proteins by yeast two-hybrid assays with GW7 as bait and identified 18 candidate proteins, including a rice homolog of TON1 (LOC_Os11g01170, hereafter OsTON1b) and a homolog of PP2A/FASS/TON2[20] (LOC_Os05g05710, hereafter OsTON2). In *A. thaliana*, TRM1 which is synonymous with *LONGIFOLIA2*[21] (LNG2), has been identified as targeting TON1, a protein which shares similarity with the human centrosomal protein FOP[22], to the cortical microtubules16, [17]. Recently, a novel TTP (TON1-TRM-PP2A) protein complex has been described to be involved in preprophase band formation and spatial control of cell division in plants[23]. We also found that GW7 could physically interact with both OsTON2 and OsTON1b, and OsTON2 interacted with OsTON1b (FIG. 2j). Similar to the *Arabidopsis* TTP protein complex, the M2 and M3 motifs of GW7 were involved in interaction with OsTON1b and OsTON2, respectively (SFIG. 9), suggesting that interactions within the TTP complex seem conserved between *Arabidopsis* and rice. Moreover, the transgenic *A. thaliana* plants constitutively overexpressing TFA GW7 cDNA under the control of the CaMV 35S promoter caused increases in longitudinal polar cell elongation; as manifested by long and narrow leaf blades (FIG. 2k, l), a phenotype which was indistinguishable from that of 35S::LNG1 and 35S::LNG2 plants[21].

The effect of allelic variation at GW7 locus on grain shape and quality was quantified in a field trial of NIL-gw7$^{HJX74}$ and NIL-GW7$^{TFA}$ plants under normal cultivation conditions12, [24]. The two NILs did not differ from one another with respect to heading date, plant height, the number of tillers per plant or the number of grains per panicle (FIG. 3a-e), but their grain shape was clearly distinct (FIG. 3f-h). The width of the NIL-GW7$^{TFA}$ grain was—6.0% less and its length—5.9% greater than those of NIL-gw7$^{HJX74}$ grain, resulting in the formation of a more slender grain (FIG. 2c, 3h). The up-regulation of GW7 slightly delayed the grain-filling rate (FIG. 3i), increased the transcriptional levels of several starch synthesis genes in developing rice endosperms, and substantially heightened the appearance quality of the rice grain (Table 4), consistent with the observed improvement of rice endosperm chalkiness. It has been reported previously that the gw8$^{Basmati}$ allele found in Basmati rice, encoding the SBP-domain transcription factor OsSPL16, is associated with the formation of more slender grains and better grain quality[12], but it is also associated with an—14% grain yield penalty (FIG. 3j, k). In contrast, there was little difference between NIL-gw7$^{HJX74}$ and NIL-GW7$^{TFA}$ plants with respect to grain weight and the overall grain yield per plant (FIG. 3j, k). These results indicate that the semidominant GW7$^{TFA}$ allele is associated with the formation of a more slender grain and better quality as well as its grain yield advantage over the Basmati gw8 allele.

The transcript abundance of GW7 in NIL-gw8$^{Basmati}$ increased over the course of panicle development when compared to NIL-GW8$^{HJX74}$, whereas GW7 expression was substantially reduced in those transgenic NIL-gw8$^{Basmati}$ plants which had been up-regulated for OsSPL16/GW8 or RNAi-silenced for GW7 (FIG. 4a), suggesting that GW7 expression was negatively regulated by OsSPL16. Furthermore, the transgenic NIL-gw8$^{Basinati}$ plants either up-regulating OsSPL16 or down-regulating GW7 expression formed wider and shorter grains than those formed by non-transgenic NIL-gw8$^{Basmati}$ plants (FIG. 4b). The inference was that GW7 must act downstream of OsSPL16. ChIP and EMSA assays demonstrated that OsSPL16 was able to bind the GW7 promoter in vitro and in vivo (FIG. 4c, d). Further EMSA experiments showed that OsSPL16 was able to bind the GTAC[25] motifs of the F8 fragment in the promoter region of GW7, whereas the mutations of GTAC to ATAC abolished its affinity (FIG. 10).

The rice protoplast transient expression assay system was further used to analyse the effect of OsSPL16 on the expression of a reporter construct containing the 2 kbp GW7 promoter fragment fused with the firefly luciferase (LUC) coding sequence. LUC activity in the cells expressing pGW7$^{HJX74}$::LUC could be detected, but co-expression of pGW7$^{HJX74}$::LUC with the p35S::OsSPL16 construct led to the reduction of LUC activity (FIG. 4e), indicating that OsSPL16 functions as a transcription repressor. In contrast, ectopic expression of OsSPL16 did not repress effectively pGW7$^{TFA}$::LUC expression in the transient expression assay (FIG. 4e). Among three binding sites of OsSPL16 (FIG. 4c), an 11 bp deletion and 18 bp insertion located at F8 fragment were identified in close proximity to the GTAC motifs in the GW7$^{TFA}$ allele (FIG. 4f), yeast one-hybrid assays demonstrated that this variations were associated with the binding activity of OsSPL16 to the GW7 promoter (FIG. 4g and FIG. 11). Although the gw8$^{Basmati}$ allele resulted in the up-regulation of GW7 (FIG. 4a), the grain size and shape produced by NIL-GW7$^{TFA}$-gw8$^{Basmati}$ were similar to those formed by NIL-GW7$^{TFA}$-Gw8$^{HJX74}$ plants. These results suggest that OsSPL16 controls grain shape via repression of GW7.

Pedigree records show that TFA and TFB were derived from the tropical *japonica* rice variety Mi31 and a resequencing exercise revealed that the TFA haplotype involving an 11 bp deletion and an 18 bp insertion was common across tropical *japonica* germplasm, but was unrepresented among the high-yielding indica cultivars, indicating that this TFA haplotype has not yet been selected during indica rice breeding programs. The gs3 allele, which proved to be a major determinant of grain length in TFA (FIG. 1c), has been widely used in indica rice breeding.[14] To test the potential of gene combinations to improve grain quality and/or grain yield, Nils carrying various combinations at qGS3 and qGW7 loci were generated in the HJX74 background. NIL-gs3-gw7$^{HJX74}$ plants formed slenderer grains than those formed by NIL-GS3-GW7$^{TFA}$ plants, whereas NIL-gs3-GW7$^{TFA}$ plants produced much longer grains than either NIL-GS3-GW7$^{TFA}$ or NIL-gs3-gw7$^{HJX74}$ plants (FIG. 12). Over three successive years of field trailing, NIL-gs3-GW7$^{TFA}$ plants were -10.7% more productive than NIL-gs3-gw7$^{HJX74}$ plants, while NIL-gs3-GW7$^{TFA}$ plants enjoyed an -12.6% grain yield advantage over HJX74 (NIL-GS3-gw7$^{HJX74}$) plants (Table 1), with substantial improvements in grain quality also being achieved (Table 5). Thus the combination of the GW7$^{TFA}$ and gs3 alleles provides a novel strategy for simultaneously improving rice yield and grain quality over what is currently achievable. Consistent with this notion, we have used QTL pyramiding of the GW7TFA and gs3 alleles and developed new high-yielding indica hybrid rice varieties (e.g. Taifengyou55 and Taifengyou208), with substantially improved grain quality.

In summary, our results suggest that allelic variants of GW7 regulate grain size, shape and quality via TTP (TON1-TRM-PP2A)-mediated cortical microtubule organization, and have provided the novel insights regarding the role of the SBP (*SQUAMOSA* PROMOTER BINDING PROTEIN)-domain transcription factors in the spatial control of plant cell division. The expression of OsSPL16 is already known to be controlled by OsmiR15612, [26], thus the manipulation of the OsmiR156-OsSPL16-GW7 regulatory module opens the way to breeding simultaneously for higher grain yield and better grain quality in rice.

TABLE 1

Pyramiding of the GW7$^{TFA}$ and gs3 alleles enhanced grain yield.

| Traits | NIL-GS3-gw7HJX74 | NIL-GS3-GW7TFA | NIL-gs3-gw7HJX74 | NIL-gs3-GW7TFA |
|---|---|---|---|---|
| Plant height (cm) | 90.41 ± 0.63a | 91.50 ± 0.73ab | 90.21 ± 0.62a | 91.92 ± 0.52ab |
| Tiller numbers per plant | 7.25 ± 0.26c | 7.30 ± 0.25c | 6.95 ± 0.29c | 7.26 ± 0.24c |
| Panicle length (cm) | 20.63 ± 0.17d | 20.96 ± 0.20d | 21.11 ± 0.36d | 21.04 ± 0.28d |
| Grain numbers per panicle | 222.30 ± 7.30e | 225.50 ± 6.57e | 213.22 ± 4.91ef | 207.00 ± 5.13f |
| 1,000-grain weight | 21.27 ± 0.02d | 21.21 ± 0.05d | 22.31 ± 0.07g | 25.00 ± 0.05h |
| Actual yield Per plot (g) | 1,151.65 ± 30.24$^i$ | 1,154.40 ± 19.86$^i$ | 1,164.79 ± 9.59$^j$ | 1,296.61 ± 34.12$^k$ |

All phenotypic data were measured from the paddy-grown NILs plants, which were planted in a randomized block design with three replications under normal cultivation conditions. Data shown as mean±s.e.m estimated from 30 plots (each plot composed 50 plants). The presence of the same lowercase letter denotes a non-significant difference between means (P<0.05).

TABLE 2

Variation in physical and chemical characteristics of milled rice grains

| Characteristics | ZS97A/MH63 | TFA/MH63 |
|---|---|---|
| Grain width (mm) | 2.30 ± 0.03$^a$ | 1.97 ± 0.02$^b$ |
| Grain length (mm) | 6.18 ± 0.03$^c$ | 7.19 ± 0.01$^d$ |
| Length-width ratio | 2.69 ± 0.07$^e$ | 3.65 ± 0.03$^f$ |
| GET | 2.75 ± 0.25$^e$ | 1.00 ± 0.01$^g$ |
| PGWC (%) | 46.00 ± 2.00$^h$ | 5.50 ± 0.87$^i$ |
| SGE (%) | 10.57 ± 0.14$_j$ | 0.69 ± 0.16$^k$ |
| AC (%) | 24.18 ± 0.93$^l$ | 23.73 ± 0.68$^l$ |
| GC (mm) | 42.00 ± 0.72$^m$ | 56.80 ± 1.34$^n$ |
| GT | 6.25 ± 0.25$^c$ | 7.00 ± 0.01$^d$ |

SGE, square of chalky endosperm; PGWC, percentage of grains with chalkiness; GET, grain endosperm transparency; AC, amylose content; GC, gel consistency; GT, gelatinization temperature. Data shown as mean±s.e.m (n=60). The presence of the same lowercase letter denotes a non-significant difference between means (P<0.05).

TABLE 3

Allelic variations at the GW7 locus

| Position | ZS97B | TFA | HJX74 |
|---|---|---|---|
| -27 | G | T | G |
| -70 | G | G | T |
| -95 | G | A | A |
| -103-115 | AGAAAGTGATA | | AGAAAGTGATA |
| -144-145 | | TATCTCATCATACCATCA | |
| -238-239 | | CACCCCCCC | |
| -292-304 | GCAGCAGCAGC | ------------------AGC | |
| -421 | T | T | A |
| -480 | C | G | C |
| -547 | G | C | C |
| -615 | G | A | G |
| -647 | T | C | T |
| -652 | G | C | G |
| -666-673 | GAAGAT | | GAAGAT |
| -699 | A | G | A |
| -715 | C | C | T |
| -746 | C | C | T |
| -757 | C | T | C |

TABLE 3-continued

Allelic variations at the GW7 locus

| Position | ZS97B | TFA | HJX74 |
|---|---|---|---|
| -793 | A | G | A |
| -827 | A | G | A |
| -916 | A | G | A |
| -956-957 | - | A | - |
| -976 | A | G | G |
| -999 | C | T | T |
| -1032 | A | C | C |
| -1051 | T | G | G |
| -1054 | C | G | C |
| -1073 | G | G | A |
| -1077-1081 |  | ATC------------ | CTC |
| -1102 | C | C | T |
| -1197 | T | - | T |
| -1239 | T | T | C |
| -1686-1687 |  | -- ------------ | AA |
| -1904 | A | C | C |

TABLE 4

The effect of the GW7$^{TFA}$ allele on physical and chemical characteristics of milled rice grains.

| Characteristics | NI | NIL-gw7$_{HJX74}$ | NIL-GW7$_{TFA}$ | NIL-gw7$_{HJX74}$ pGW7$^{TFA}$::GW7$^{TFA}$ |
|---|---|---|---|---|
| GW (mm) | 2.18 ± 0.02$^a$ | 2.05 ± 0.01$^b$ | 2.08 ± 0.01$^b$ | |
| GL (mm) | 5.81 ± 0.02$^c$ | 6.05 ± 0.02$^d$ | 5.97 ± 0.05$^d$ | |
| LWR | 2.66 ± 0.02$^e$ | 2.95 ± 0.01$^f$ | 2.86 ± 0.01$^f$ | |
| PGWC (%) | 56.67 ± 1.86$^g$ | 29.33 ± 1.86$^h$ | 35.00 ± 1.53$^h$ | |
| SGE (%) | 9.45 ± 0.18$^i$ | 4.88 ± 0.13$^j$ | 5.20 ± 0.10$^j$ | |
| GET | 0.58 ± 0.01$^k$ | 0.62 ± 0.01$^l$ | 0.60 ± 0.01$^l$ | |
| AC (%) | 27.91 ± 1.46$^m$ | 22.55 ± 1.30$^n$ | 24.73 ± 0.41$^o$ | |
| GC (mm) | 38.50 ± 1.50$_p$ | 40.50 ± 2.50$_q$ | 40.50 ± 1.50$_q$ | |
| GT | 7.00 ± 0.01$^r$ | 7.00 ± 0.01$^r$ | 7.00 ± 0.01$^r$ | |

GW, grain width;
GL, grain length;
LWR, length-width ratio;
PGWC, percentage of grains with chalkiness;
SGE, square of chalky endosperm;
GET, grain endosperm transparency;
AC, amylose content;
GC, gel consistency;
GT, gelatinization temperature.
Data shown as mean ± s.e.m (n = 30). The presence of the same lowercase letter denotes a non-significant difference between means (P < 0.05).

TABLE 5

Pyramiding of the GW7TFA and gs3 alleles improves grain quality in indica rice breeding.

| C$^i$ | NIL-GS3-gw7HJX7 | NIL-GS3-GW7TFA | NIL-gs3-gw7HJX74 | NIL-gs3-GW7TFA |
|---|---|---|---|---|
| GW (mm) | 2.19 ± 0.01a | 2.05 ± 0.01b | 2.00 ± 0.01b | 1.96 ± 0.01c |
| GL (mm) | 5.81 ± 0.01d | 6.06 ± 0.02e | 6.41 ± 0.03f | 6.99 ± 0.05g |
| LWR | 2.65 ± 0.01h | 2.95 ± 0.01i | 3.20 ± 0.02j | 3.57 ± 0.02k |
| PGWC (%) | 50.67 ± 1.45l | 28.67 ± 2.19m | 40.67 ± 1.45n | 31.33 ± 2.33m |
| SGE (%) | 9.24 ± 0.24o | 5.20 ± 0.11p | 9.07 ± 0.22q | 7.69 ± 0.19r |
| GET | 0.57 ± 0.02s | 0.63 ± 0.01t | 0.48 ± 0.01u | 0.62 ± 0.01t |
| AC (%) | 27.28 ± 0.75m | 22.29 ± 0.26v | 28.18 ± 1.13m | 27.55 ± 0.18m |

TABLE 5-continued

Pyramiding of the GW7TFA and gs3 alleles improves grain quality in *indica* rice breeding.

| $C^i$ | NIL-GS3-gw7HJX7 | NIL-GS3-GW7TFA | NIL-gs3-gw7HJX74 | NIL-gs3-GW7TFA |
|---|---|---|---|---|
| GC (mm) | 39.00 ± 1.73n | 41.00 ± 2.65n | 37.50 ± 2.50w | 50.50 ± 2.50l |
| GT | 7.00 ± 0.01g | 7.00 ± 0.01g | 7.00 ± 0.01g | 7.00 ± 0.01g |

GW, grain width;
GL, grain length;
LWR, length-width ratio;
PGWC, percentage of grains with chalkiness;
SGE, square of chalky endosperm;
GET, grain endosperm transparency;
AC, amylose content;
GC, gel consistency;
GT, gelatinization temperature.
Data shown as mean ± s.e.m (n = 60). The presence of the same lowercase letter denotes a non-significant difference between means (P < 0.05).
$C^i$Characteristics

TABLE 6

Primers used for QTL analysis and genotypin

| Primers | Chr. | Forward sequence (5'-3') | Reverse sequence (5'-3') |
|---|---|---|---|
| RM1282 | 1 | AAgCATgACAgCTgCAAgAC (SEQ ID NO: 127) | ggggATgAAgggTAATTTCg (SEQ ID NO: 128) |
| RM8097 | 1 | TACATACACgTTCATgTgCC (SEQ ID NO: 129) | CgAgCgTAggAAgACTACC (SEQ ID NO: 130) |
| RM6703 | 1 | CAgCAAACCAAACCAAgCC (SEQ ID NO: 131) | gCgAggAggAggAgAAAAAg (SEQ ID NO: 132) |
| RM6703 | 1 | CAgCAAACCAAACCAAgCC (SEQ ID NO: 133) | gCgAggAggAggAgAAAAAg (SEQ ID NO: 134) |
| RM8100 | 1 | TgTTAATTCCgTgTCCgA (SEQ ID NO: 135) | TgAAAATCAAATTTgTTACggt (SEQ ID NO: 136) |
| STS-1-169 | 1 | gAgTTTgggTgTAgCTTCCA (SEQ ID NO: 137) | TCTgAACTCggCCAAAgTAg (SEQ ID NO: 138) |
| RM6321 | 1 | ggCTCTACCTCgCTgTTgTC (SEQ ID NO: 139) | ACgAATATAACCTgCggCAg (SEQ ID NO: 140) |
| RM7581 | 2 | CATTTCAACTAgTAAgCgTgtc (SEQ ID NO: 141) | TTACAgCCgCTATgATAAgg (SEQ ID NO: 142) |
| STS-2-71 | 2 | AgCCCACCgTATACCAAgTct (SEQ ID NO: 143) | ATCCATAgATgTTCTCTTgTCC (SEQ ID NO: 144) |
| STS-2-94 | 2 | TggACAAAgAgggAgATAgCA (SEQ ID NO: 145) | TCCCTATCCTgTCCgACATC (SEQ ID NO: 146) |
| STS-2-103 | 2 | TggATgCAATgTgACCAAAg (SEQ ID NO: 147) | TgAgCTAAgATgTgCAgTgTCA (SEQ ID NO: 148) |
| STS-2-108 | 2 | AATATgCgTgTgCgTgTTgT (SEQ ID NO: 149) | CgTTTTCgTgggTTgATTTT (SEQ ID NO: 150) |
| RM3763 | 2 | TCTCTgAACACACCCACACC (SEQ ID NO: 151) | TgTTTTgATCTCAgCTCCCC (SEQ ID NO: 152) |
| RM6933 | 2 | gTAgCAgAAACCAATgCTC (SEQ ID NO: 153) | ATTCgCgATAAATATggACT (SEQ ID NO: 154) |
| RM3763 | 2 | TCTCTgAACACACCCACACC (SEQ ID NO: 155) | TgTTTTgATCTCAgCTCCCC (SEQ ID NO: 156) |
| RM4108 | 3 | AgCCCCATgATAAgAgATTgta (SEQ ID NO: 157) | CATgCAACTCTgCTAAACgAA (SEQ ID NO: 158) |
| STS-3-48 | 3 | CAgCTAggATgTTgAAggATCg (SEQ ID NO: 159) | gCCAgCTTTgACTgCACTgC (SEQ ID NO: 160) |

TABLE 6-continued

Primers used for QTL analysis and genotypin

| Primers | Chr. | Forward sequence (5'-3') | Reverse sequence (5'-3') |
|---|---|---|---|
| STS-3-70 | 3 | gCCTgACCATACTgAACAACC (SEQ ID NO: 161) | gAgAAgCCTAATTggggACA (SEQ ID NO: 162) |
| STS-3-74 | 3 | TggACAAACTgggTTgTgTg (SEQ ID NO: 163) | TCATATgACgAgTggCAACC (SEQ ID NO: 164) |
| RM15281 | 3 | CgggCTTATATCTTTggCAaatgg (SEQ ID NO: 165) | gCCTCCTCCCTCCTTTCTCg (SEQ ID NO: 166) |
| RM3646 | 3 | ACTAgAgCACCCTCgCTgAg (SEQ ID NO: 167) | CTCAgCCACCCCATCAAC (SEQ ID NO: 168) |
| RM1350 | 3 | ATCAgCAAgAAAgCTCTgCTCC (SEQ ID NO: 169) | AggAAATTCgCCCTAgTAgATAG (SEQ ID NO: 170) |
| RM7000 | 3 | TgAACTCgTTCTTTTgCACCg (SEQ ID NO: 171) | ACgAAgTCCCCTTCTTTTCAAC (SEQ ID NO: 172) |
| RM16204 | 3 | TAACCATCTgCACCACCgTACC (SEQ ID NO: 173) | CTCTATgTgCCgTgATCAAATCC (SEQ ID NO: 174) |
| Tindel-4 | 4 | ACggggAgATgATTATggTg (SEQ ID NO: 175) | CTCgTTgACTgCCTCgTgT (SEQ ID NO: 176) |
| RM8213 | 4 | AgTgATACAAAgATgAgTTggg (SEQ ID NO: 177) | TCCTAATgTTgggTgggTAAAg (SEQ ID NO: 178) |
| P5M106F | 4 | CgCTggTAAACTCCATTCCT (SEQ ID NO: 179) | CCTACTCCCAACAgTCCCAA (SEQ ID NO: 180) |
| P5M104F | 4 | AAggAAACATACTTAgcatgacct (SEQ ID NO: 181) | CTggTTAgCCTCTATgggCA (SEQ ID NO: 182) |
| RM131F | 4 | TCCTCCCTCCCTTCgCCCACTg (SEQ ID NO: 183) | CgATgTTCgCCATggCTgCTCC (SEQ ID NO: 184) |
| RM17798 | 5 | TAATAggAAgAgTgCgTCAgAgC (SEQ ID NO: 185) | TCgACCAgTgATAACCAgTAacc (SEQ ID NO: 186) |
| RM592F | 5 | TCTTTggTATgAggAACACC (SEQ ID NO: 187) | AgAgATCCggTTTgTTgTAA (SEQ ID NO: 188) |
| RM5844 | 5 | AACgTggCATCCATgTTAgTACC (SEQ ID NO: 189) | AgCTAggAgCCATTgTCgAAgg (SEQ ID NO: 190) |
| STS-5-58 | 5 | gCACACTCAATTgCTCAAATC (SEQ ID NO: 191) | gggCTCAAAgTAgTgCTCCA (SEQ ID NO: 192) |
| STS-5-70 | 5 | AACgAgCATCACAgCCTTgT (SEQ ID NO: 193) | AggCAAAggAgATgCCTACA (SEQ ID NO: 194) |
| RM334 | 5 | TgTTCAgTgTTCAgTgCCACC (SEQ ID NO: 195) | ACCTTgATCTTggTggATgCC (SEQ ID NO: 196) |
| STS-6-9.0 | 6 | CgCTTATTCggATTACgAgA (SEQ ID NO: 197) | TTTCCATCCACTTCTACCTCA (SEQ ID NO: 198) |
| RM585 | 6 | CTgTgACTgACTTggTCATAgg (SEQ ID NO: 199) | CAgTCTTgCTCCgTTTgTTg (SEQ ID NO: 200) |
| RM217 | 6 | ATCgCAgCAATgCCTCgTg (SEQ ID NO: 201) | TgCgTTTgTgTTTggCTCg (SEQ ID NO: 202) |
| STS-6-24 | 6 | CgCTgTCAgAgACTgAgAgAgA (SEQ ID NO: 203) | TAggTgACgTACgCgTggTA (SEQ ID NO: 204) |
| RM2126 | 6 | TCTTgCAgTTTACAgACgAA (SEQ ID NO: 205) | ACAgATTCAggCCTTgTTTA (SEQ ID NO: 206) |
| RM7193 | 6 | CCCTAgTTTTCCAAATggCC (SEQ ID NO:207) | ATgTgggAATTTCTAgCCCC (SEQ ID NO: 208) |
| RM7193 | 6 | CCCTAgTTTTCCAAATggCC (SEQ ID NO: 209) | ATgTgggAATTTCTAgCCCC (SEQ ID NO: 210) |

TABLE 6-continued

Primers used for QTL analysis and genotypin

| Primers | Chr. | Forward sequence (5'-3') | Reverse sequence (5'-3') |
|---|---|---|---|
| RM20069 | 6 | gCgAgCgAgAggAgAgATAgACg (SEQ ID NO: 211) | CgAATTCggCACgAgTAATAggg (SEQ ID NO: 212) |
| RM3 | 6 | ACACTgTAgCggCCACTg (SEQ ID NO: 213) | CCTCCACTgCTCCACATCTT (SEQ ID NO: 214) |
| STS-6-100 | 6 | ACCTCATAgCTTggCAAAAA (SEQ ID NO: 215) | AgCTCgACCTCTTCATggTg (SEQ ID NO: 216) |
| RM4584 | 7 | CCTATTTAATATAgCACCAg (SEQ ID NO: 217) | CCATTTAAACATAgAAAAAC (SEQ ID NO: 218) |
| E50408S | 7 | ACCTgAgTTCCCTCCTATTT (SEQ ID NO: 219) | CTTAACCTCgTgCATgAAAA (SEQ ID NO: 220) |
| RM182 | 7 | TgggATgCAgAgTgCAgTTggC (SEQ ID NO: 221) | CgCAggCACggTgCCTTgTAAg (SEQ ID NO: 222) |
| S13453 | 7 | ATAACCATCAAACCgCAAgA (SEQ ID NO: 223) | CTCggATgTAAAgTgAgATAAA (SEQ ID NO: 224) |
| M11 | 7 | CAgTAACTCAAgCATAAACgC (SEQ ID NO: 225) | TCgTCgCAAgggTAggTg (SEQ ID NO: 226) |
| M12 | 7 | AAATgAgTTTAAgTCggCTggA (SEQ ID NO: 227) | ggAACggTTTTgTTggTTgA (SEQ ID NO: 228) |
| M10 | 7 | TggTCAAATCATgggCTAAT (SEQ ID NO: 229) | TATTATTgTgCCTgCgATCC (SEQ ID NO: 230) |
| M14 | 7 | CCACATCTCATCTCACgCgTC (SEQ ID NO: 119) | CATCCAACTgCAgAgCAgCTC (SEQ ID NO: 120) |
| M13 | 7 | gCTTATTTCAACCCCCCCTCTC (SEQ ID NO: 121) | gACgCgTgAgATgAgATgTgg (SEQ ID NO: 122) |
| M1 | 7 | CCATAgTAAgACgACCTT (SEQ ID NO: 231) | gATATTCTgTCAgCAgTT (SEQ ID NO: 232) |
| M2 | 7 | TCAgTTTAATCCATTATTCAAg (SEQ ID NO: 233) | TCTACgTACggAgggAAT (SEQ ID NO: 234) |
| M3 | 7 | TATTTTggAgACCgTgTC (SEQ ID NO: 235) | CTgAATgTTgCATTgTgC (SEQ ID NO: 236) |
| M4 | 7 | CgATCTTCCgATCCACCg (SEQ ID NO: 237) | CCggCTTCATgggCTTAg (SEQ ID NO: 238) |
| M5 | 7 | gCCATgTgAggTgATTAg (SEQ ID NO: 239) | CTACggTTCCCAgCTTCT (SEQ ID NO: 240) |
| M6 | 7 | CAgggATgTCAACgAgCC (SEQ ID NO: 241) | CCCgTATCACCgACAATg (SEQ ID NO: 242) |
| M7 | 7 | gACTATgCAgTAgAggAg (SEQ ID NO: 243) | TgTCTAgTAgCAATCAAg (SEQ ID NO: 244) |
| M8 | 7 | TTTTgggACgggAggAgT (SEQ ID NO: 245) | gACCgAgTgAgTTgTCgTatct (SEQ ID NO: 246) |
| M9 | 7 | AATgCCATTATTATgTAgTC (SEQ ID NO: 247) | CCTCCAATTATCTgACActc (SEQ ID NO: 248) |
| S1 | 7 | TACCTCTgCTTgCTCCTTg (SEQ ID NO: 249) | CATgTTCTACTgCACCTTC (SEQ ID NO: 250) |
| S5 | 7 | ATTAgCTgCAACTCgTTCTgC (SEQ ID NO: 251) | TggAAgAgTATggCCTAgaaa (SEQ ID NO: 252) |
| S6 | 7 | CATCCATTCCATTCCCTgTTAC (SEQ ID NO: 253) | ATCTTATTgTTgTTgCCggtgt (SEQ ID NO: 254) |
| RM505 | 7 | AgAgTTATgAgCCgggTgTg (SEQ ID NO: 255) | gATTTggCgATCTTAgCAgC (SEQ ID NO: 256) |

TABLE 6-continued

Primers used for QTL analysis and genotypin

| Primers | Chr. | Forward sequence (5'-3') | Reverse sequence (5'-3') |
|---|---|---|---|
| RM234 | 7 | ACAgTATCCAAggCCCTgg (SEQ ID NO: 257) | CACgTgAgACAAAgACggAg (SEQ ID NO: 258) |
| RM118 | 7 | CCAATCggAgCCACCggAgAgC (SEQ ID NO: 259) | CACATCCTCCAgCgACgccgag (SEQ ID NO: 260) |
| RM11 | 7 | TCTCCTCTTCCCCCgATC (SEQ ID NO: 261) | ATAgCgggCgAggCTTAg (SEQ ID NO: 262) |
| RM336 | 7 | CTTACAgAgAAACggCATCg (SEQ ID NO: 263) | gCTggTTTgTTTCAggTTCg (SEQ ID NO: 264) |
| RM337 | 8 | gTAggAAAggAAgggCAgAg (SEQ ID NO: 265) | CgATAgATAgCTAgATgTggCC (SEQ ID NO: 266) |
| OSR30 | 8 | TCACCgTCgAATCgAATCCA (SEQ ID NO: 267) | AgTCgAggAAggAgAAgTTC (SEQ ID NO: 268) |
| PSM152 | 8 | CCCCgTATACCCggATTATT (SEQ ID NO: 269) | TggTCgTggACAgTgCTCTA (SEQ ID NO: 270) |
| RM1376 | 8 | CATgTgTgATgACTgACAgg (SEQ ID NO: 271) | ggTgCTgTgATgATTCTTTC (SEQ ID NO: 272) |
| P5M154 | 8 | CATTgggTTTgTgCATTCAg (SEQ ID NO: 273) | CAACgACCCATATTCCAACC (SEQ ID NO: 274) |
| STS-8-60 | 8 | CgCAggATgTAgAggATTgA (SEQ ID NO: 275) | gTgCCgACAgCACTTggT (SEQ ID NO: 276) |
| STS-8-67 | 8 | TTTATTTggCCCTTggATCA (SEQ ID NO: 277) | AACCAAAgCATgACgACgtt (SEQ ID NO: 278) |
| PSM710 | 8 | gCCAgCCAAgAAAAgCgACA (SEQ ID NO: 279) | TCTTgAgATCCCACTCCATg (SEQ ID NO: 280) |
| RM447 | 8 | CCCTTgTgCTgTCTCCTCTC (SEQ ID NO: 281) | ACgggCTTCTTCTCCTTCTC (SEQ ID NO: 282) |
| RM2855 | 9 | ggAgCTTAgAATCTCACCTA (SEQ ID NO: 283) | CgCATTTTCCTATACATaca (SEQ ID NO: 284) |
| RM257 | 9 | CAgTTCCgAgCAAgAgTACTC (SEQ ID NO: 285) | ggATCggACgTggCATATg (SEQ ID NO: 286) |
| RM3919 | 9 | gTgAgTgATCTTCATCAgTg (SEQ ID NO: 287) | CgATggTTATCTgTAAAcag (SEQ ID NO: 288) |
| RM278 | 9 | gTAgTgAgCCTAACAATAATC (SEQ ID NO: 289) | TCAACTCAgCATCTCTgtcc (SEQ ID NO: 290) |
| RM245 | 9 | ATgCCgCCAgTgAATAgC (SEQ ID NO: 291) | CTgAgaatCCAATTatctgggg (SEQ ID NO: 292) |
| RM7545 | 10 | gTATCCgCTCCgTTTTCATC (SEQ ID NO: 293) | gAggggggggTgTAgAATAg (SEQ ID NO: 294) |
| RM4455 | 10 | CTCTCAAAgAACTAggACTC (SEQ ID NO: 295) | gAgAAggTATgATAACCaat (SEQ ID NO: 296) |
| RM1873 | 10 | CTgACAggACATTAAAAAAC (SEQ ID NO: 297) | CCTCATCCTTAATCTCtttta (SEQ ID NO: 298) |
| RM3773 | 10 | CTggATgAAAggATACAACA (SEQ ID NO: 299) | CACATTATCTgTCAAggtcc (SEQ ID NO: 300) |
| RM304 | 10 | TCAAACCggCACATATAAgac (SEQ ID NO: 301) | gATAgggAgCTgAAggAgatg (SEQ ID NO: 302) |
| RM3123 | 10 | ATTTCCCACACATCTCgCTg (SEQ ID NO: 303) | gTgTCgCCggTCAAgAAC (SEQ ID NO: 304) |
| RM228 | 10 | CTggCCATTAgTCCTTgg (SEQ ID NO: 305) | gCTTgCggCTCTgCTTAC (SEQ ID NO: 306) |

TABLE 6-continued

Primers used for QTL analysis and genotypin

| Primers | Chr. | Forward sequence (5'-3') | Reverse sequence (5'-3') |
|---|---|---|---|
| RM6673 | 10 | CATCgCATCgTATCgTATCg (SEQ ID NO: 307) | gCTTCAAACACgCCTTCttc (SEQ ID NO: 308) |
| RM288 | 11 | CCggTCAgTTCAAgCTCTg (SEQ ID NO: 309) | ACgTACggACgTgACgAC (SEQ ID NO: 310) |
| RM7557 | 11 | gTgTACTgCCATgAAAggCC (SEQ ID NO: 311) | gAAgTgCCTTTgCAggAgAg (SEQ ID NO: 312) |
| RM1812 | 11 | CAgCTAgTgAgCTCCTAgTg (SEQ ID NO: 313) | gCTAACCCACCAACTTAttc (SEQ ID NO: 314) |
| RM6894 | 11 | AATCTCCACTgCAgCgATTC (SEQ ID NO: 315) | CgAATggTCAAACgTAggTg (SEQ ID NO: 316) |
| RM202 | 11 | CAgATTggAgATgAAgTCCtcc (SEQ ID NO: 317) | CCAgCAAgCATgTCAATgTA (SEQ ID NO: 318) |
| RM7 120 | 11 | TgCCCAAAATATATgAAacc (SEQ ID NO: 319) | TTTTCTTgTTgAATgggAAC (SEQ ID NO: 320) |
| RM2064 | 11 | gCTACCTTAgCTAggTgATC (SEQ ID NO: 321) | ATgTAAAATTTgCATgTTTg (SEQ ID NO: 322) |
| RM144 | 11 | TgCCCTggCgCAAATTTgAtcc (SEQ ID NO: 323) | gctagaggagatcagatggtagtgcatg (SEQ ID NO: 324) |
| Tindel-12-2 | 12 | ACCgTAgCgTTAgCATggAC (SEQ ID NO: 325) | ACTACgAgAATgCggTgCTT (SEQ ID NO: 326) |
| R462B | 12 | CTTggCTCTCgTgAAAgACC (SEQ ID NO: 327) | CCATgCATggggATATAAgg (SEQ ID NO: 328) |
| Tindel-12-26 | 12 | CTgAggTgggAgTTgTACCC (SEQ ID NO: 329) | TCTTCgATACCCATgCCAAT (SEQ ID NO: 330) |
| RM491 | 12 | ACATgATgCgTAgCgAgTTg (SEQ ID NO: 331) | CTCTCCCTTCCCAATTCCTC (SEQ ID NO: 332) |
| R2672A | 12 | CCCACCACCAACTTTAgCCC (SEQ ID NO: 333) | TgACATggAAATTgACAttctt (SEQ ID NO: 334) |
| RM3226 | 12 | CTTggCTCTCgTgAAAgACC (SEQ ID NO: 335) | CCATgCATggggATATAAgg (SEQ ID NO: 336) |
| RM27970 | 12 | TCCACCActctgACgTCtactaacc (SEQ ID NO: 337) | CTgCgggAAgTgTAggAgAAgC (SEQ ID NO: 338) |
| C53903S | 12 | TTTTCATCCTAgATggTTgC (SEQ ID NO: 339) | TACgATCCAAgAAgCTgTCT (SEQ ID NO: 340) |
| E541S | 12 | TAATAgATCgggACTAgACT (SEQ ID NO: 341) | CAATACTTTAAAACTTggAC (SEQ ID NO: 342) |
| C61722S | 12 | gAgTAATggCAgTTTgATTg (SEQ ID NO: 343) | gCAggTTACgCTAgTTAAAA (SEQ ID NO: 344) |

TABLE 7

Primers used for DNA constructs and transcripts analysis

| Primers | Sequence (5'-3') |
|---|---|
| pGW7HidIIIF | CCCAAgCTTACACTCCAgCCATTAAgCACCg (SEQ ID NO: 345) |
| PGW7SalIR | gCgTCgACCTCCTCCgACTCCgACTCCTCC (SEQ ID NO: 346) |
| GW7-F-SalI | gCgTCgACATgCCTCCggCgAgggTgCTC (SEQ ID NO: 347) |

TABLE 7-continued

Primers used for DNA constructs and transcripts analysis

| Primers | Sequence (5'-3') |
|---|---|
| GW7-R-KpnI | cggggTACCTCAgCTTgTACTACTAAATgACAgC (SEQ ID NO: 348) |
| GW7-SalI-R-0 | gCgtcgacgCTTgTACTACTAAATgACAgCTgC (SEQ ID NO: 349) |
| GW7-XbaI-F | gCTCTAgAATgCCTCCggCgAgggTg (SEQ ID NO: 350) |
| gW7-EcoRIF | gAATTCATgCCTCCggCgAgggTgCTC (SEQ ID NO: 351) |
| gW7-SalIR | gTCgACTCAgCTTgTACTACTAAATgACAgCTgC (SEQ ID NO: 352) |
| GW7pucc-BglIIF | AgATCTAAACTgTTACCAAgAgCTCC (SEQ ID NO: 353) |
| GW7pucc-XhoIR | CTCgAggTTCCACTgTCCACCTTgCATC (SEQ ID NO: 354) |
| GW7pucc-XbaIF | TCTAgAAAACTgTTACCAAgAgCTCC (SEQ ID NO: 355) |
| Gw7pucc-SalIR | gTCgACgTTCCACTgTCCACCTTgCATC (SEQ ID NO: 356) |
| 841R | gCgTCgACCTACTTCCTTAATTgAAgCgACT (SEQ ID NO: 357) |
| 842F | gCgAATTCATgTACAACggATggCgACTT (SEQ ID NO: 358) |
| 882R | gCgTCgACCTATggATCCTCAACCAATAgCA (SEQ ID NO: 359) |
| 883F | gCgAATTCATgCTgAATggAATAgAAgA (SEQ ID NO: 360) |
| 620F | gCgAATTCATgAgCATggTgAAggAgATC (SEQ ID NO: 361) |
| 720R | gCgTCgACCTAggCCTCAAAATTTTCTggT (SEQ ID NO: 362) |
| OsTON1b-EcoRIF | gCgAATTCATggACgACTACgCgCgggA (SEQ ID NO: 363) |
| OsTON1b-SalIR | gCgTCgACTTACTCAgCACCgTCgCCTggA (SEQ ID NO: 364) |
| OsTON1b-SalIF | gCgTCgACaATggACgACTACgCgCgggA (SEQ ID NO: 365) |
| OsTON1b-SpeIR | gACTAgTTTACTCAgCACCgTCgCCTggA (SEQ ID NO: 366) |
| OsTON2-SalIF | gCgTCgACaATgAgCACCgCCTCCggCgACg (SEQ ID NO: 367) |
| OsTON2-SpeIR | gACTAgTTCAggCCTCTTCCACTTgCTC (SEQ ID NO: 368) |
| OsTON2-EcoRIF | gCgAATTCaTgAgCACCgCCTCCggCgACg (SEQ ID NO: 369) |
| OsTON2-SalIR | gCgTCgACTCAggCCTCTTCCACTTgCTC (SEQ ID NO: 370) |
| qActinF | CCACTATgTTCCCTggCATT (SEQ ID NO: 371) |
| qActinR | gTACTCAgCCTTggCAATCC (SEQ ID NO: 372) |

TABLE 7-continued

Primers used for DNA constructs and transcripts analysis

| Primers | Sequence (5'-3') |
|---|---|
| qGW7F | CCCCTAgCATCgACACCAAg (SEQ ID NO: 373) |
| qGW7R | CgggTTCCAgCACTCCTCT (SEQ ID NO: 374) |
| p330-2k-KpnIF | ggggTACCACACTCCAgCCATTAAgCACCg (SEQ ID NO: 375) |
| p330SalIR | gCgTCgACCTCCTCCgACTCCgACTCCTCC (SEQ ID NO: 376) |
| p330-1K-KpnIF | ggggTACCgCAATATCTATAACACgACATTAg (SEQ ID NO: 377) |
| p330-0.5K-KpnI | ggggTACCCAAACCCgTCAAgAggAACCT (SEQ ID NO: 378) |
| p330-Bridge1F | TCTCATCTCACgCgTCCCAA (SEQ ID NO: 379) |
| pGW7-EcoRV-F | CAgATATCATCACCgTTTCATATTATACg (SEQ ID NO: 380) |
| pGW7-BamHI-R | CgggATCCCTCCTCCTCCgACTCCgACT (SEQ ID NO: 381) |
| OsSPL16-F-XbaI | gCTCTAgAATggAgTgggATCTCAAgATg (SEQ ID NO: 382) |
| OsSPL16-R-EcoRI | ggAATTCCTACTgCCATgAgAACggCAg (SEQ ID NO: 383) |

TABLE 8

Primers used for Chl P-PCR analysis

| Primers | Sequence (5'-3') | PCR product |
|---|---|---|
| Chip1F | gCCATTAAgCACCgAAgAC (SEQ ID NO: 384) | 273 bp |
| Chip1R | gCTACTggTTAgCCgAAAAg (SEQ ID NO: 385) | |
| Chip2F | CTTTTCggCTAACCAgTAgC (SEQ ID NO: 386) | 326 bp |
| Chip2R | gTgAAAATgCCTACTCgCTC (SEQ ID NO: 387) | |
| Chip3F | gTAggAgCgAgTAggCATTTTC (SEQ ID NO: 388) | 240 bp |
| Chip3R | TACCgCCAgAggTTAggg (SEQ ID NO: 389) | |
| Chip4F | TAACCTCTggCggTACgATg (SEQ ID NO: 390) | 313 bp |
| Chip4R | TAATgTCgTgTTATAgATATTgC (SEQ ID NO: 391) | |
| Chip5F | gCAATATCTATAACACgACATTAg (SEQ ID NO: 392) | 250 bp |
| Chip5R | gCTCACTTACgTTTTATTCCC (SEQ ID NO: 393) | |
| Chip6F | CggAgggAATAAAACgTAAg (SEQ ID NO: 394) | 288 bp |
| Chip6R | CgATTAggTTCCTCTTgACg (SEQ ID NO: 395) | |
| Chip7F | AAACCCgTCAAgAggAACC (SEQ ID NO: 396) | 305 bp |
| Chip7R | ggAgggATggggATTgg (SEQ ID NO: 397) | |
| Chip8F | ATCCCTCCCgCTTATTTC (SEQ ID NO: 398) | 258 bp |
| Chip8R | ACACTCCAgCCATTAAgCACCg (SEQ ID NO: 399) | |

TABLE 9

Primers used for EMSA assays

| Primer | Sequence (5'-3') |
|---|---|
| T-F | TAgTgTACgTACCTCTTAgTgTACgTACCTCTTAgTgTACgTACCTCT (SEQ ID NO: 400) |

TABLE 9-continued

Primers used for EMSA assays

| Primer | Sequence (5'-3') |
|---|---|
| T-R | AgAggTACgTACACTAAgAggTACgTACACTAAgAggTACgTACACTA (SEQ ID NO: 401) |
| Z-F | TAgTgTgCgTgCCTCTTAgTgTgCgTgCCTCTTAgTgTgCgTgCCTCT (SEQ ID NO: 402) |
| Z-R | AgAggCACgCACACTAAgAggCACgCACACTAAgAggCACgCACACTA (SEQ ID NO: 403) |
| T-F1-Biotin | TAgTgTACgTACCTCTTAgTgTACgTACCTCTTAgTgTACgTACCTCT-bio (SEQ ID NO: 404) |
| Z-F1-Biotin | TAgTgTgCgTgCCTCTTAgTgTgCgTgCCTCTTAgTgTgCgTgCCTCT-bio (SEQ ID NO: 405) |
| HJX1F | CCATTgACACACCATACCACATCTCATCTCACgCgTCCCAAAgAAAg TgATAgTgTACgTACC (SEQ ID NO: 406) |
| HJX1F-bio | CCATTgACACACCATACCACATCTCATCTCACgCgTCCCAAAg AAAgTgATAgTgTACgTACC-bio (SEQ ID NO: 407) |
| HJX1R | ggTACgTACACTATCACTTTCTTTgggACgCgTgAgATgAgATg TggTATggTgTgTCAATgg (SEQ ID NO: 408) |
| OsSPL16-F-BamHI | CgCggATCCATggAgTgggATCTCAAgATg (SEQ ID NO: 409) |
| OsSPL16-R-EcoRI | CggAATTC CATCTgCCATgAgAACggCAg (SEQ ID NO: 410) |

TABLE 10

| OSGW7 homologues as in FIG. 13, including percentages identity | |
|---|---|
| >gi\|115473227\|ref\|NP_001060212.1\|Os07g0603300 [*Oryza sativa Japonica* Group] cDNA SEQ ID NO: 1, gDNA SEQ ID NO: 2, protein SEQ ID NO: 3 | 100% |
| >gi\|659106250\|ref\|XP_008453286.1\|PREDICTED: protein LONGIFOLIA 2 [*Cucumis melo*] cDNA SEQ ID NO: 9, gDNA SEQ ID NO: 10, protein SEQ ID NO: 11 | 27% |
| >gi\|502178002\|ref\|XP_004516159.1\|PREDICTED: protein LONGIFOLIA 1-like [*Cicer arietinum*] cDNA SEQ ID NO: 12, gDNA SEQ ID NO: 13, protein SEQ ID NO: 14 | 30% |
| >gi\|571534728\|ref\|XP_006600592.1\|PREDICTED: protein LONGIFOLIA 1-like isoform X1 [*Glycine max*] cDNA SEQ ID NO: 15, gDNA SEQ ID NO: 16, protein SEQ ID NO: 17 | 30% |
| >TRM3 cDNA SEQ ID NO: 18, gDNA SEQ ID NO: 19, protein SEQ ID NO: 20 | 29% |
| >gi\|685349425\|ref\|XP_009110333.1\|PREDICTED: protein LONGIFOLIA 2-like [*Brassica rapa*] cDNA SEQ ID NO: 21, gDNA SEQ ID NO: 22, protein SEQ ID NO: 23 | 28% |
| >TRM4 cDNA SEQ ID NO: 24, gDNA SEQ ID NO: 25, protein SEQ ID NO: 26 | 31% |
| >gi\|727597037\|ref\|XP_010471507.1\|[*Camelina sativa*] cDNA SEQ ID NO: 27, gDNA SEQ ID NO: 28, protein SEQ ID NO: 29 | 31% |
| >gi\|674890310\|emb\|CDY42438.1\|BnaC02g22700D [*Brassica napus*] cDNA SEQ ID NO: 30, gDNA SEQ ID NO: 31, protein SEQ ID NO: 32 | 33% |
| >gi\|460380631\|ref\|XP_004236058.1\|PREDICTED: protein LONGIFOLIA 2 [*Solanum lycopersicum*] cDNA SEQ ID NO: 33, gDNA SEQ ID NO: 34, protein SEQ ID NO: 35 | 30% |
| >TRM1 cDNA SEQ ID NO: 36, gDNA SEQ ID NO: 37, protein SEQ ID NO: 38 | 28% |
| >TRM2 cDNA SEQ ID NO: 39, gDNA SEQ ID NO: 40, protein SEQ ID NO: 41 | 29% |
| >gi\|115470249\|ref\|NP_001058723.1\|Os07g0109400 [*Oryza sativa Japonica* Group] cDNA SEQ ID NO: 42, gDNA SEQ ID NO: 43, protein SEQ ID NO: 44 | 30% |
| >gi\|297612088\|ref\|NP_001068172.2\|Os11g0587300 [*Oryza sativa Japonica* Group] cDNA SEQ ID NO: 45, gDNA SEQ ID NO: 46, protein SEQ ID NO: 47 | 49% |

TABLE 10-continued

OSGW7 homologues as in FIG. 13, including percentages identity

| | |
|---|---|
| >gi\|115453551\|ref\|NP_001050376.1\|Os03g0418700 [*Oryza sativa Japonica* Group] cDNA SEQ ID NO: 48, gDNA SEQ ID NO: 49, protein SEQ ID NO: 50 | 52% |
| >gi\|242040587\|ref\|XP_002467688.1\|SORBIDRAFT_01g032400 [*Sorghum bicolor*] cDNA SEQ ID NO: 51, gDNA SEQ ID NO: 52, protein SEQ ID NO: 53 | 44% |
| >gi\|474436675\|gb\|EMS68230.1\|hypothetical protein TRIUR3_01497 [*Triticum urartu*] cDNA SEQ ID NO: 54, gDNA SEQ ID NO: 55, protein SEQ ID NO: 56 | 73% |
| >gi\|414887497\|tpg\|DAA63511.1\|TPA: hypothetical protein ZEAMMB73_243937 [*Zea mays*] cDNA SEQ ID NO: 57, gDNA SEQ ID NO: 58, protein SEQ ID NO: 59 | 65% |
| >gi\|242040587\|ref\|XP_002467688.1\|SORBIDRAFT_01g032400 [*Sorghum bicolor*] cDNA SEQ ID NO: 411, gDNA SEQ ID NO: 412, protein SEQ ID NO: 413 | |

TABLE 11

OSGS3 and homologues as in FIG. 14, Percentages identity

| | |
|---|---|
| >gi\|571464775\|ref\|XP_006583163.1\|PREDICTED: guanine nucleotide-binding protein subunit gamma 3-like [*Glycine max*] cDNA SEQ ID NO: 60, gDNA SEQ ID NO: 61, protein SEQ ID NO: 62 | 39% |
| >gi\|727564089\|ref\|XP_010454370.1\|PREDICTED: guanine nucleotide-binding protein subunit gamma 3-like [*Camelina sativa*] cDNA SEQ ID NO: 63, gDNA SEQ ID NO: 64, protein SEQ ID NO: 65 | 43% |
| >gi\|79577677\|ref\|NP_680175.2\|guanine nucleotide-binding protein subunit gamma 3 [*Arabidopsis thaliana*] cDNA SEQ ID NO: 66, gDNA SEQ ID NO: 67, protein SEQ ID NO: 68 | 43% |
| >gi\|672121994\|ref\|XP_008784313.1\|PREDICTED: guanine nucleotide-binding protein subunit gamma 3-like isoform X2 [*Phoenix dactylifera*] cDNA SEQ ID NO: 69, gDNA SEQ ID NO: 70, protein SEQ ID NO: 71 | 43% |
| >gi\|670378582\|ref\|XP_008670224.1\|PREDICTED: keratin-associated protein 5-4-like [*Zea mays*] cDNA SEQ ID NO: 72, gDNA SEQ ID NO: 73, protein SEQ ID NO: 74 | 44% |
| >gi\|242044808\|ref\|XP_002460275.1\|hypothetical protein SORBIDRAFT_02g025860 [*Sorghum bicolor*] cDNA SEQ ID NO: 75, gDNA SEQ ID NO: 76, protein SEQ ID NO: 77 | 44% |
| >gi\|254680089\|gb\|ACT78691.1\|DEP1 [*Triticum urartu*] cDNA SEQ ID NO: 78, gDNA SEQ ID NO: 79, protein SEQ ID NO: 80 | 38% |
| >gi\|208293842\|gb\|ACI25445.1\|DEP1 [*Hordeum vulgare*] cDNA SEQ ID NO: 81, gDNA SEQ ID NO: 82, protein SEQ ID NO: 83 | 40% |
| >gi\|297609540\|ref\|NP_001063287.2\|Os09g0441900 [*Oryza sativa Japonica* Group] cDNA SEQ ID NO: 84, gDNA SEQ ID NO: 85, protein SEQ ID NO: 86 | 39% |
| >gi\|219563180\|gb\|ACL27948.1\|keratin associated protein [*Oryza sativa Indica* Group] cDNA SEQ ID NO: 87, gDNA SEQ ID NO: 88, protein SEQ ID NO: 89 | 45% |
| >gi\|226502088\|ref\|NP_001144472.1\|GS3-like protein [*Zea mays*] cDNA SEQ ID NO: 90, gDNA SEQ ID NO: 91, protein SEQ ID NO: 92 | 54% |
| >gi\|514818719\|ref\|XP_004984061.1\|PREDICTED: guanine nucleotide-binding protein subunit gamma 3-like [*Setaria italica*] cDNA SEQ ID NO: 93, gDNA SEQ ID NO: 94, protein SEQ ID NO: 95 | 66% |
| >gi\|721629965\|ref\|XP_010230134.1\|PREDICTED: guanine nucleotide-binding protein subunit gamma 3-like [*Brachypodium distachyon*] cDNA SEQ ID NO: 96, gDNA SEQ ID NO: 97, protein SEQ ID NO: 98 | 61% |
| >gi\|242035515\|ref\|XP_002465152.1\|hypothetical protein SORBIDRAFT_01g032830 [*Sorghum bicolor*] cDNA SEQ ID NO: 99, gDNA SEQ ID NO: 100, protein SEQ ID NO: 101 | 52% |
| >gi\|475499176\|gb\|EMT04144.1\|hypothetical protein F775_43686 [*Aegilops tauschii*] cDNA SEQ ID NO: 102, gDNA SEQ ID NO: 103, protein SEQ ID NO: 104 | 68% |
| >gi\|474437862\|gb\|EMS68265\|hypothetical protein TRIUR3_07930 [*Triticum urartu*] cDNA SEQ ID NO: 105, gDNA SEQ ID NO: 106, protein SEQ ID NO: 107 | 83% |
| >gi\|566086681\|gb\|AHC55372.1\|grain size protein [*Triticum aestivum*] cDNA SEQ ID NO: 108, gDNA SEQ ID NO: 109, protein SEQ ID NO: 110 | 76% |
| >gi\|85822770\|gb\|ABC84855.1\|grain length and weight protein [*Oryza sativa*] cDNA SEQ ID NO: 5, gDNA SEQ ID NO: 6, protein SEQ ID NO: 7 gs3: cDNA SEQ ID NO: 111, gDNA SEQ ID NO: 112, protein SEQ ID NO: 113 | 100% |
| >gi\|674962933\|emb\|CDX70936.1\|BnaCO3g10200D [*Brassica napus*] cDNA SEQ ID NO: 414, protein SEQ ID NO: 415 | 55% |
| >gi\|694270600\|gb\|AIS73136.1\|heterotrimeric G protein gamma subunit 4 [*Brassica nigra*] cDNA SEQ ID NO: 416, protein SEQ ID NO: 417 | 55% |

REFERENCES

1, Sasaki, A. et al. A mutant gibberellin-synthesis gene in rice. Nature 416, 312-316 (2002).
2, Spielmeyer, W. Ellis, M. H. & Chandler, P. M. Semidwarf (sd-1), "green revolution" rice, contains a defective gibberellin 20-oxidase gene. Proc Natl Acad Sci USA 99, 9043-9048 (2002).
3, Yuan, L. Hybrid rice breeding for super high yield. Hybrid Rice 12, 1-6 (1997).
4, Xing, Y., Zhang, Q. Genetic and molecular bases of rice yield. Annu Rev Plant Biol. 61, 421-442 (2010). 5, Tian, Z. et al. Allelic diversities in rice starch biosynthesis lead to a diverse array of
rice eating and cooking qualities. Proc Natl Acad Sci USA 106, 21760-21765 (2009).
6, Ahn, S. N., Bollich, C. N., McClung, A. M., Tanksley, S. D. RFLP analysis of genomic regions associated with cooked-kernel elongation in rice. Theor Appl Genet. 87, 27-32 (1993).
7, Aluko, G., Martinez, C., Tohme, J., Castano, C., Bergman, C., Oard, J. H. QTL mapping of grain quality traits from the interspecific cross Oryza sativa×O. glaberrima. Theor Appl Genet. 109, 630-639 (2004).
8, Wang, L. et al. Genetic basis of 17 traits and viscosity parameters characterizing the eating and cooking quality of rice grain. Theor Appl Genet. 115, 463-476 (2007).
9, Zhou, L. et al. Fine mapping of the grain chalkiness QTL qPGWC-7 in rice (Oryza sativa L.). Theor Appl Genet. 118, 581-590 (2007).
10, Nelson, J. C. et al. Mapping QTL main and interaction influences on milling 20
quality in elite US rice germplasm. Theor Appl Genet. 122, 291-309 (2011).
11, Cai, X., Wang, Z., Xing, Y., Zhang, J., Hong, M. Aberrant splicing of intron 1 leads to the heterogeneous 5' UTR and decreased expression of waxy gene in rice cultivars of intermediate amylose content. Plant J. 14, 459-465 (1998).
12, Wang, S. et al. Control of grain size, shape and quality by OsSPL16 in rice. Nat. Genet. 44, 950-954 (2012).
13, Li, Y. et al. Chalk5 encodes a vacuolar H(+)-translocating pyrophosphatase influencing grain chalkiness in rice. Nat. Genet. 46, 494-497 (2014).
14, Fan, C. et al. GS3, a major QTL for grain length and weight and minor QTL for grain width and thickness in rice, encodes a putative transmembrane protein. Theor. Appl. Genet. 112, 1164-1171 (2006).
15, Azimzadeh, J. et al. Arabidopsis TONNEAU1 proteins are essential for preprophase band formation and interact with centrin. Plant Cell 20, 2146-2159 (2008).
16, Drevensek, S. et al. The Arabidopsis TRM1-TON1 interaction reveals a recruitment network common to plant cortical microtubule arrays and eukaryotic centrosomes. Plant Cell 24, 178-191 (2012).
17, Patel, H., Truant, R., Rachubinski, R. A., Capone, J. P. Activity and subcellular compartmentalization of peroxisome proliferator-activated receptor alpha are altered by the centrosome-associated protein CAP350. J Cell Sci. 118, 175-186 (2005).
18, Shao, G. et al. Allelic variation for a candidate gene for GS7, responsible for grain shape in rice. Theor. Appl. Genet. 125:1303-1312 (2012).
19, Qiu, X., Gong, R., Tan, Y., Yu, S. Mapping and characterization of the major 21
quantitative trait locus qSS7 associated with increased length and decreased width of rice seeds. Theor. Appl. Genet. 125, 1717-1726 (2012).
20, Kirik, A., Ehrhardt, D. W., Kirik, V. TONNEAU2/FASS regulates the geometry of microtubule nucleation and cortical array organization in interphase Arabidopsis cells. Plant Cell, 24, 1158-1170 (2012).
21, Lee, Y. K., et al. LONGIFOLIA1 and LONGIFOLIA2, two homologous genes, regulate longitudinal cell elongation in Arabidopsis. Development 133, 4305-4314 (2006).
22, Yan, X., Habedanck, R., Nigg, E. A. A complex of two centrosomal proteins, CAP350 and FOP, cooperates with EB1 in microtubule anchoring. Mol Biol Cell 17, 634-644 (2006).
23, Spinner, L. et al. A protein phosphatase 2A complex spatially controls plant cell division. Nat Commun. 4, 1863 (2013).
24, Sun, H. et al. Heterotrimeric G proteins regulate nitrogen-use efficiency in rice. Nat Genet. 46, 652-656 (2014).
25, Lu, Z. et al. Genome-wide binding analysis of the transcription activator ideal plant architecture1 reveals a complex network regulating rice plant architecture. Plant Cell 15, 3743-3759 (2013).
26, Xie, K., Wu, C., Xiong, L. Genomic organization, differential expression, and interaction of SQUAMOSA promoter-binding-like transcription factors and microRNA156 in rice. Plant Physiol. 142, 280-293 (2006).
27, Huang, X. et al. Natural variation in the DEP1 locus enhances grain yield in rice. Nat. Genet. 41, 494-497 (2009).
28, Jiang, C. et al. Root architecture and anthocyanin accumulation of phosphate 22
starvation responses are modulated by the GA-DELLA signaling pathway in Arabidopsis. Plant Physiol. 145, 1460-1470 (2007).
29, Gendrel, A. V., et al., Profiling histone modification patterns in plants using genomic tiling microarrays. Nat Methods 2, 213-218 (2005).
30, Chen, M., Bai, W., Sze-To, W. H., Canlas, P. E., Bartley, L. E. Ronald, P. C. A rice transient assay system identifies a novel domain in NRR required for interaction with NH1/OsNPR1 and inhibition of NH1-mediated transcriptional activation. Plant Methods 8, 6 (2012).
31, Bracha-Drori, K. et al. Detection of protein-protein interactions in plants using bimolecular fluorescence complementation. Plant J. 40, 419-427 (2004).
32, Li, G. et al. Coordinated transcriptional regulation underlying the circadian clock in Arabidopsis. Nat Cell Biol. 13, 616-622 (2011).
33. Mao et al Linking differential domain functions of the GS3 protein to natural variation of grain size in rice, PNAS, 107, 45, 19579-19584 (201)

SEQUENCE LISTING (435 sequences)

SEQ ID NO: 1 - DNA, 2823 bp, Oryza sativa Japonica Group
atgcctccggcgagggtgctcggcggcggtggtggaggaggggggttgggggacgaggcgccggagctggagaggcagatggggtgcatggccggcatcttccagatcttcgaccgccgccagcgcctgctcaccgcgcgccgccgccgcccgccgcccaagatgctgcccccgggcccaggccatactcttccaagaagcagcagcaatgttgcagcgcagagctcaagtacctccaagatcgttctggagaaaacattcagcaagagcatgaccgagaacagtagcctttcaatagagtcatcaagggcttcctgttcttcctcctcatgctcatccttttcatcacttgatggcaacaaatcgatccaacaagagctgccatacatcaacgagcagctctttgtacagaggccactgaagagctcaccaagtctgaaggacccagtcatggacaccaggtctggacagtcaaacattggcttcagagacattgtgaaggactccattaaccgggacaccggaggccttactgtcaagacctcggtgaaggatgcaaggaggaatgggcagtacaaagactcaccaaggcccttgctgctctccaaatcaatggatgggacctacgtcatcgggatcgataggagcaccaaggtccctgctaatgctgttgaatccagcaggcgattcccagagcagtcgcgcttctcatgcgatgatcggcggctcctgaggccagttgaagctcaagagaacaagaagccttccacaaggctcaaagagcttcccagactgtccttggacagtaggaaagaaaccctgagctcgagttctcgccagaagaccttcagttacaggagaaccgacgacagtctcatggacgctcttaggcctcaagattccccaggccataggcgtgccagcagtgtcattgccaagctgatggggttggaagaagcacccaatgctacaggggtgctaactgttgatagctacgagcctgaaagatcaccaagaccagcagaagacacacagaaggagcatccagtaccttcccctagaagattttgtcaggatccacgcgagtcgctgccaaaagatgagtctccggcaatgaaaaccaagccttctccaagaattcttactgaatctgctccttggaggcagcaggagaagattgccaccagtagcaaggcttcacaatgccgagatgctgaagttcgaccaaggactgcatctctctatgcctacattgagagaaggggcggggggcttgagttcttggagtgcaacaaggacttcagggctctcaggatactggaagcgctgcacgcaaaggatgccaagcgccagaacgatggcaatggcgcattaacagtggctgctcagcaggcaggggatgcactgaacaccagttccagacacttccagcctcccattgtagtcatgaagccagcaagaagcactgagaagcagccaggggtttcacttgcttcagttgatccccttgcagggttcagaaacctcaggaagctgcaggccagagatgcgccttgcattggcgagcatgagaccagcacaaatgagaaggtccattctcgcatttcaagggcacaatccaagtccgatgaacctgctagccgtgcaagctctccaaggcctacaggatcatcaagccccaggacagtgcagcggaaggcagagtcagaaaggaggtctcgtccacctgtctcaccgaagtccccaagcaagaagtccagtgaagcagcctctcctggaggaagaacaagaacaaagccttctcaagggaagaaccaccgtgacaatgaggtctcgaagagtccaagaagcagaatcagcatggtgaaggagatcgacataagcatcatggattttcaaaagcccctagcatcgacaccaagtcacaagggaactccttcagttcttgcttcagatcagaagattaattcactggagaatgccccaagtcccatctctgtcctcgacacgtcatattaccatacaagactgtcatattcattcaaagatggggagacacattcttcagaggagtgctggaacccgaacagcctgcctgacacgccacagtccaagacgagcagtgaagtcagccagatcaaaccagaaaattttgaggccctcatccagaagcttgagcaattgcagtcaatgaatgatgaagttgcaaacaagaaagatcatcagtacatttacgagatactcttagcatctggcctcctgcacaaagaacttagcttcgtagccatgcctggtcaagcatggccatcaagctgcctgatcaatccagagctcttcctcattcttgaacaaacaaagccagattttgcttcagcagaccaaactgttaccaagagctccaaagctaacacagaaaagcttcatcgaagaattgtattcgatctggtaaacgaaattacagctcagaagatgaacattcattgctcggcaagtcagtcagccaagtcgcttcaattaaggaagtacaacggatggcgactttttaaggacctgtgcacagaggttgacaggcttcaatctgagagttcagcgataaaatgctctgaagaggatggggatgaaagaatgctattggttgaggatccactgaatggaatagaagattggagcttcgatagtgaatcgccaagcacggttttggagatcgaaagattaatctacaaggacctcattgacgaggtcatatgggatgaggccacagggaagatgcaaggtggacagtggaacctaaagaggcagctgtcatttagtagtacaagctga

SEQ ID NO: 2 - DNA, 5013 bp, Oryza sativa Japonica Group
ctgcatggcattcgcacgccattgacacatatctcatcataccatcaccataccacatctcatctcacgcgtcccaagtgtacgtacctctgcttgctccttggctttctgagctgagctgctctgcagttggatgtgcgtgagctggtgatctgggaggagtcggagtcggagggggagatgcctccggcgagggtgctcggcggcggtggtggaggaggggggttgggggacgaggcgccggagctggagaggcagatggggtgcatggccggcatcttccagatcttcgaccgccgccagcgcctgctcaccgcgcgccgccgccgcccgccgcccaagatgctgcccccgggcccaggttaacggcgcatttttttttctctgcacatttcttcctgtggcatctgctcctcttcccctgttctgttttcacaatcaccagcttcactccattcacacacccaagatcatgtcagctgcgtctcaagcatttttacaagctgtttctcttttcttttccctctctatcttggttactgtttttaagtattattactactgttttactgtttttaagccatctgtttttaagtgttactttctgaattattagctgcaactcgttctgcaaatgttgaccagagattagaaaagttgggtgcttcttttgtgggacagagaactactaatttcatgtgttggttgaaactcgagagacaagtcctttcagactattattcaaagtttggtaacagataacagttggaaggtgcagtagaacatgcattggttggtaaagcagtttattgctagtagaaagtttttttttttaaaaaaatgctattaattggaaaatgggagttttcttcacttcttcacaactgcaggatactaatttcatctttaaccttcttttattgaaaacagagtacccccctcaccctagataaaagacaacagtacaaaaaaacagatggcttacagtagttgtgatcataaaggcctttctttaaagaatgtaatatggcagcacacattgacataaggacaggcactgacgtggatttgggtgcccagaagtagcatgaggggataacttttcgcactgactgaaaaggacagattatcagttagttactaaaattttcattaatataatgaaactgaagaggacagcttaacatttggttttaaaatttccattctcgtcaatgataaattaactgaagaagacagcttaacaattgattataaaacttccattcatgtatatgattaattgattatattattgaacaacaattaagaaaacacacaccttttcaccgctcaaatccatccattttgctcataccagactgtcttaataaatagctataattcctcaattcacagtttaggctgtaattataatgtcttcttttttttcttttctaggccatactcttccaagaagcagcagcaatgttgcagcgcagagctcaagtacctccaagatcgttctggtaattttcctattcgaactccaactgttgtttgttaccacttgccagtaaaaaaaccatcccatgcatgcatcagaagtatactttggccacatcaagaagagtactctaacttatggattgcctttgcaggagaaaacattcagcaagagcatgaccgagaacagtagcctttcaatagagtcatcaagggcttcctgttcttcctcctcatgctcatccttttcatcacttgatggcaacaaatcgatccaacaagagctgccatacatcaacgagcagctctttgtacagaggccactgaagagctcaccaagtctgaaggacccagtcatggacaccaggtctggacagtcaaacattggcttcagagacattgtgaaggactccattaaccgggacaccggaggccttactgtcaagacctcggtgaaggatgcaaggaggaatgggcagtacaaagactcaccaaggcccttgctgctctccaaatcaatggatgggacctacgtcatcgggatcgataggagcaccaaggtccctgctaatgctgttgaatccagcaggcgattcccagagcagtcgcgcttctcatgcgatgatcggcggctcctgaggccagttgaagctcaagagaacaagaagccttccacaaggctcaaagagcttcccagactgtccttggacagtaggaaagaaaccctgagctcgagttctcgccagaagaccttcagttacaggagaaccgacgacagtctcatggacgctcttaggcctcaagattccccaggccataggcgtgccagcagtgtcattgccaagctgatggggttggaagaagcacccaatgctacaggggtgctaactgttgatagctacgagcctgaaagatcaccaagaccagcagaagacacacagaaggagcatccagtaccttcccctagaagattttgtcaggatccacgcgagtcgctgccaaaagatgagtctccggcaatgaaaaccaagccttctccaagaattcttactgaatctgctccttggaggcagcaggagaagattgccaccagtagcaaggcttcacaatgccgagatgctgaagttcgaccaaggactgcatctctctatgcctacattgagagaaggggcggggggcttgagttcttggagtgcaacaaggacttcagggctctcaggatactggaagcgctgcacgcaaaggatgccaagcgccagaacgatggcaatggcgcattaacagtggctgctcagcaggcaggggatgcactgaacaccagttccagacacttccagcctcccattgtagtcatgaagccagcaagaagcactgagaagcagccaggggtttcacttgcttcagttgatccccttgcagggttcagaaacctcaggaagctgcaggccagagatgcgccttgcattggcgagcatgagaccagcacaaatgagaaggtccattctcgcatttcaagggcacaatccaagtccgatgaacctgctagccgtgcaagctctccaaggcctacaggatcatcaagccccaggacagtgcagcggaaggcagagtcagaaaggaggtctcgtccacctgtctcaccgaagtccccaagcaagaagtccagtgaagcagcctctcctggaggaagaacaagaacaaagccttctcaagggaagaaccaccgtgacaatgaggtctcgaagagtccaagaagcagaatcagcatggtgaaggagatcgacataagcatcatggattttcaaaagcccctagcatcgacaccaagtcacaaggtatacataataaaatcagatataaggaaaccagccagttcaatcaatgttttttaccttgtacatcactaattagtaaatatgttctccttttttacagggaactccttcagttcttgcttcagatcagaagattaattcactggagaatgccccaagtcccatctctgtcctcgacacgtcatattaccatacaagactgtcatattcattcaaaggtgagaagttgatacagtattttttctgcattaagataaccaactgcaagaacagcaacatgatggattctactgtttgctctcattcaatccagaagcccatagtgtcattcaaaggacaagcatagttagctgtaagcgtgccaatgacgctagtgacagataatctgcaataaaagctacaaccaggtagcttgtggtcctgatatggggaggaaccacagcagatggactgttgcagagttgcagctagatgaccagaacattgttaggttatagcaaggcccacatgttgcacttgcttatgcaggacagcaggagcatgatgtgtgtcttctggtgtatatgcattgctagtatagacgtgcccaccaatgtccccctctacaaatacacctagcatgagtatgattcagttgatccgtagacagatagtgatatcagatctcctgtccagtacatgtttttctgcagttgttaggtctgataatgaataccgtatttctgtctggtatattactattttctgcagttgtattgaacactggtttctgaatacatgcatatccttttctgcttgttcagatggggagacacattcttcagaggagtgctggaacccgaacagcctgcctgacacgccacagtccaagacgagcagtgaagtcagccagatcaaaccagaaaattttgaggccctcatccagaagcttgagcaattgcagtcaatgaatgatgaagttgcaaacaagaaagatcatcagtacatttacgagatactcttagcatctggcctcctgcacaaagaacttagcttcgtagccatgcctggtcaagcatggccatcaagctgcctgatcaatccagagctcttcctcattcttgaacaaacaaagccagattttgcttcagcagaccaaactgttaccaagagctccaaagctaacacagaaaagcttcatcgaagaattgtattcgatctggtaaacgaaattacagctcagaagatgaacattcattgctcggcaagtcagtcagccaagtcgcttcaattaaggaagtacaacggatggcgactttttaaggacctgtgcacagaggttgacaggcttcaatctgagagttcagcgataaaatgctctgaagaggatggggatgaaagaatgctattggttgaggatccactgaatggaatagaagattggagcttcgatagtgaatcgccaagcacggttttggagatcgaaagattaatctacaaggacctcattgacgaggtcatatgggatgaggccacagggaagatgcaaggtggacagtggaacctaaagaggcagctgtcatttagtagtacaagctgaatatgcttggcaatacatgtttcccctaggaagcttagcaactacactacactagtgaatgtaacatcttgtattttgctgaagattaaactatagaagaaatataaatattcc

SEQ ID NO: 3 - protein, 940 aa, Oryza sativa Japonica Group
MPPARVLGGGGGGGGLGDEAPELERQMGCMAGIFQIFDRRQRLLTARRRRPPPKMLPPGPGHTLPRSSSNVAAQSSSTSKIVLEKTFSKSMTENSSLSIESSRASCSSSSCSSFSSLDGNKSIQQELPYINEQLFVQRPLKSSPSLKDPVMDTRSGQSNIGFRDIVKDSINRDTGGLTVKTSVKDARRNGQYKDSPRPLLLSKSMDGTYVIGIDRSTKVPANAVESSRRFPEQSRFSCDDRRLLRPVEAQENKKPSTRLKELPRLSLDSRKETLSSSSRQKTFSYRRTDDSLMDALRPQDSPGHRRASSVIAKLMGLEEAPNATGVLTVDSYEPERSPRPAEDTQKEHPVPSPRRFCQDPRESLPKDESPAMKTKPSPRILTESAPWRQQEKIATSSKASQCRDAEVRPRTASLYAYIERRGGGLEFLECNKDFRALRILEALHAKDAKRQNDGNGALTVAAQQAGDALNTSSRHFQPPIVVMKPARSTEKQPGVSLASVDPLAGFRNLRKLQARDAPCIGEHETSTNEKVHSRISRAQSKSDEPASRASSPRPTGSSSPRTVQRKAESERRSRPPVSPKSPSKKSSEAASPGGRTRTKPSQGKNHRDNEVSKSPRSRISMVKEIDISIMDFQKPLASTPSHKGTPSVLASDQKINSLENAPSPISVLDTSYYHTRLSYSFKDGETHSSEECWNPNSLPDTPQSKTSSEVSQIKPENFEALIQKLEQLQSMNDEVANKKDHQYIYEILLASGLLHKELSFVAMPGQAWPSSCLINPELFLILEQTKPDFASADQTVTKSSKANTEKLHRRIVFDLVNEITAQKMNIHCSASQSAKSLQLRKYNGWRLFKDLCTEVDRLQSESSAIKCSEEDGDERMLLVEDPLNGIEDWSFDSESPSTVLEIERLIYKDLIDEVIWDEATGKMQGGQWNLKRQLSFSSTS

SEQ ID NO: 4 - DNA, 2001 bp, Oryza sativa Japonica Group
tatatcatacttatatggcatagttaacaccggcaacaacaataagatgagcttgatcttaatctcttctcctttcaagtgcactaaagtccaatgaccgtactacgtgttactaccacattcacatagctagctgtgccctcataattgtgctgtccaacgtactggtactactacacggtttggaaaaccagtccgttccaaaccaaacatctccaagatccgttctcttttcggctaaccagtagcagcagcagcagcagatcgagccttaattcaactagaaccaacctgcaagatccaaaaaaaaaaaaaacaactgatgcagcagtaataaaagagatcacacattcacagtggctttggttgcatcttttgcattggtgatcaccatttggagtgaccacacacactgcagatgcatgaactccatcatggcgaggtgtttttactgctgctgcccctacacgaggaatctatccgtcagatcagatgggcctctgggtaaaaattttagctatggtggtagtagtaggagcgagtaggcattttcacgagcatgtggtgtgcacgagagaaagcgagtgagtgagtgagagcgtgtgcgtagtggcaatgtcacacgaatcgctgtgcatctcgcgtatgatgagacgcgacgcggctgtcgctggcgcacgcgttaacctcggactctcctggcaacgatcgacatccggggtgggcgttcacctttccgattgaatgtccgatccctaacctctggcggtacgatggttttcgtcgaattccgaccattttttttctttgaaatttgaatgtctaggagccattcggagttttactcggagtctgcttttgttccgtgtcgaaaccaaagaaattttgcggtcttcgatcgatcttcatcggaaaaaccgtctccgtaacgcggcgcggtgcgaggtgagtcacatactccatcaccgtttcatattatacgtcgtttaactttttctcttagtcaaaattcttctaagtttgactaaatttatagaaaaaaatagcaatatctataacacgacattagtttcattaaatttagtattgaatatattttgatacaatacttgttttctactggaaatgttactatatttttaataaacttaaataacttttcctaaaagtcagacgaattatgatatgaaacggaagaagtatctagcaaattactactctctctgtccctctctaaattcatagaattatgacgtgtcacatctacgtacggagggaataaaacgtaagtgaggtgtttgaatcttcttaagatgaagatgaagataaagattaagtgttccacgcaaaacgaggtggtaataacgtgtgattaattaggttttacttattacaaacttgaataatggattaatctgatattaatatcagagcaactttcatacaccaaaaacgccgtttagctatccaaaatgttggagaaacgaacgcagcagccagaacgtaatccaaagccgtcaagaggaacctaatcgaaaccatatacccccgttgcggcagcgggttggacaatatggtattgtggccgtggtagggagaggtggtggtgcgcgcgcggtcacatgcccaaccccgcaacaatgatcgaagccccccctcacatgcgtggccggctcgcgtcgcgggcagcagcattcggccgtgggtgccgggagctggacatggaccatcgacacgccttgacccacaccccccccaccccaccaatcccccatccctcccgcttatttcaaccccccctctccctctcctcacgacaccctgcatggcattcgcacgccattgacacatatctcatcataccatcaccataccacatctcatctcacgcgtcccaagtgtacgtacctctgcttgctccttggctttctgagctgagctgctctgcagttggatgtgcgtgagctggtgatctgggaggagtcggagtcggagggggag

SEQ ID NO: 5 - DNA, 699 bp, Oryza sativa Japonica Group
atggcaatggcggcggcgccccggcccaagtcgccgccggcgccgcccgacccatgcggccgccaccgcctccagctcgccgtcgacgcgctccaccgcgagatcggattcctcgagggtgaaataaattcaatcgaagggatccacgctgcctccagatgctgcagagaggttgacgaattcatcggaagaactcctgatccattcataacgatttcatcggagaagcgaagtcatgatcattctcaccacttcttgaagaagtttcgctgtttgtgcagagcaagtgcgtgctgcctcagctacctctcctggatctgctgctgcagcagcgccgccggcggctgctcatcctcctcctcctcctccttcaacctcaagaggccgagctgctgctgcaactgcaactgcaactgctgctcctcctcctcctcctcatgtggggcggcgttaacgaagagtccgtgtcgctgccgccgccgcagctgctgctgccgtcgctgctgctgcggcggcgtcggcgtccgcgcgtgcgcgagctgcagctgctccccgccgtgcgcgtgctgcgcgccgccgtgcgcgggatgctcgtgccgctgcacctgcccgtgcccgtgccccggcggctgctcctgcgcgtgcccggcgtgcaggtgctgctgcggcgtccctcgttgctgccccccctgcttgtga

SEQ ID NO: 6 - DNA, 5609 bp, Oryza sativa Japonica Group
gatcatctccattatcggaacttcggagtgacatggcaatggcggcggcgccccggcccaagtcgccgccggcgccgcccgacccatgcggccgccaccgcctccagctcgccgtcgacgcgctccaccgcgagatcggattcctcgaggtacaatctatctctatctgtctatatcactaccattcatactccttcgatcttgcttcaaaacaaaaaaatatatatttcctacttcatattcatatacacacgtacggcttgctatctgtcgaattgtttgcttctgcatgcatgcatcactctcattgtaagtttttcccagcttaaaaccactccttttatcttcgttcttcttccttcttgtttttttttaaaaaaacaacaactcatttaatcttcatatagtgtatcatgcatcatttgcttctttgatcagttccccaaaaactgctcctctcttcccagccaaataattaaacttaagcaaacaagcaagttgaactgatgatccaataaaacaaaacaaaaccgatcgaataggaagtcaatggcatataccagctgctatagctgaagccacgaatgcttagcttagctctagtcgatccctgttgactgttcaacacactgcactaacacaccagttaatgagctgattaattaaaccattaaatgagcttaacgggcggctagcttcttcctctgggcccgtgccgatcgtaccatcggtttgcgcgtccctccacctaaactctctgccttgttattccctttgcctagtactacatgcatttgcatcatcatcccatcaccaatagtactacgtttcaactggattttggtggtgtccaaccatatcatatttggttttgttctctagtttactcctacattagtctctagcggttttgtggagtactaaagaaaacaactaatcagccagggtttaacgtttaatcggttggtggttttgttaattaatttcatctactattttagacttcacaggtcttcgagctataagcatcgattgccatgcatcaatcgatgctggtccacgctagtttctgagttctgactagctctcttaattgtgctttgacctactttaattaattaaccagtggctgcgtcactcattgaccaacattgtcatgttacccggactgattttttttttctttaaaaaaacaccggatatattattagttagtgtatatatatgtctgctcaagaagcgcatgcatatagtttctcgtcaaacaaaaaatgtactgtatgctcaaagcatctgttttggaattgtcatattcgcctttataattaaaataattaaaatggtgatgcccagctttttttttcctccaataatttatttattggcttgatttcctgtgctattaggagtaaaactactccgttttaattagcaccatttttaaagcttctaaaattaacctaagtaaagtacgacagtacttgctgtctagctttaaatgttttgggtgttaaaatatccctcagacatcacctgaaaagttgacaggctaaacacatgcccatctccctcgtttacttaaattaattcgaacaaacaactgtatatatatttcttgcagggtgaaataaattcaatcgaagggatccacgctgcctccagatgctgcagagagtaagccagcctgctgtttctttttgtactacttccatttcttctcgtctttactcttaccatgcattcacaaaatatacttacttaccccagtttttgatcatgaactttgaccgttatctttttaagcaacttcaataaaataggtttaaatgcaaatgttatgtacaccattgattataaaaccttggcaaatgaaagtaaaaaaccagcacatttaatttctgaacgttgggagtattattatttttatatcttttactatcatttaatcatagtatcgtgcaagctttttgagtgtaattaggttgcttaaggtaaaaaaatgtaactaggttacatttagtactaaactgaacatttaattagtaatgtttcgttaagtaactgtaatttcaatgcatgcatgtcctcccgtaagagcaagtttaatagtatagccaactactagctccaatttatttatagacaatctaatagctcattcatacaataattacatactacactattaatatctgatcccacctgtcatacacatactgcattttggagtccgtgctatagctgactacaaatctatagtccgctgctcttctctctctttatttatctccttaaaatatgtttgcagctggcttatagcctgctattgtacctgctctgaaaatagtgcagagactgttcaaaaagtcattgcacaataactattcacatggaactgtgaaaagtatatattggaacttactagctagatccttttgggaacatgggaaaagccaagtcacgtgtggaatccctattccctgtgttcttcagctagaagagtgaaaataatgtactactactatacggagatgaaattacagcaggagcagaaagcgggaaaaaaactttaaatcaattaaacaaacctctctctgcaaaattcaacaccagcaacgaacaactcatcaagttcttgtgttatgtaccggccggtaactaattgttgtttgcataagcgaaacggtatatttgcaaacaaaaaataatttatgaataaaacttttatatacatgttcttaattatctcaaaacaaaggttgaaaaataaacttcgatgaaaaaatctcaaaatcaattccaaatttatggtgaaaattttaaattttgtctgataaacataagtataagcaaaaaaaaaagtaaagcaatgtcactatgttaatggtattggtatatatacctttgagtttctgtctgtactttaggagtacatgctacgaacatgttttcttggcttctatttcgttggaattacttgcgtattgtgggccagacgcctggtgaacttcgtcgattgtgtggactaattaagctcacctgaaataagtggttgaaaacaaggctaaagatgattttaatcatggattttggcttggaaatttttttgtagggttgacgaattcatcggaagaactcctgatccattcataacgatgtatggattttcaggtcgagaatttgtctttaacttcgcacgactgttattttttttcttattaattctctgtttacaagcagttcatcggagaagcgaagtcatgatcattctcaccacttcttgaagaagtttcggtactcacttcattcccggatcttaatgtatatatgcatatctgcactgtgctaattggtgtacacattatgtgatcatcagtccaagttaattattacttacaaaactgaactaataaacactagaaaatatgtaacttgcaaagtacatattgaatcagggattcatatatagaactccacctgcagatttcttccaatatatatatgctgtcaccatgttttcacttgtcacctagtacacctttgactgggagactttccttgatgatcgacgtggtcatattcttcagattgatttaatttcagatagaaaaaaatattgtttacttagtttctctccttcagtaagagagatgtgcaagaccagcgatcaaactatatgaactgttcgtttcatgataaaaaaaacatgatatggaataactaggtgattcaacatataatggctgataatccctcgtttcaggagataccatcagttttctacttttctacttttctccatgttctctttttcatgtttgaggtggatcggagcttgtattagatgtttgctcagctcaattattgctgcagatttccctatatagcctccactgtatatatactccctccgattccataatttaatgatattttgaacaatgacgctgtctccaaaatatatctttcactttgttttcctattataatatatacaataaaaaaaatacatatttacttttcttataaatagtttcaaagacaaatctatatatgttgttatataactcttttaaactaaatatttttaaagttatagtcaaagttacaaaagttggacctcaaacatgtataaaacgtcgagaattgtatatctgatcaaccaataatttgtagtgcattgtcttaaaaaaattgcatttctagctatgtatctagataattacaagaaccaggtgaaatcacattttatttttactggaccacgaactcattgtttaattacttccagccttgcactaaataacaataattgaacctggcatcacctgcacaattaatttggacacaaagtaaacatgaatgcaacatacttcgtttcatattgtttgttggtgtaggatttaaattttgtgtcaaaatacttgccgttcttactacattcttaagcactttgagaactaaccttctcttcctacccttcatcaatacagtcatactaactaattggctcttatgccttgaaaaactaattaggatgtatttaatgagggtaaccatgtaatctgccaccagtgaatgcaattttggttcaaaatttcgggcccccgccctaaaaagtcattatctcgatagaatttttttgaatttagtcaaaatttattcaaatttagccaaattgtgttaaatttcaaataatttcagtctaaaaagtgctgaaaatcccgaaatttaggttctaccgaaatggccggaaattttcagcgaaaatcaaacatgaaaaccttgtctgccacatttgttagtttgtgtaaagatttgctagaacgataagtaatttgaagcggatgtatattatatatcccacaaaaccatcaacttgttaattacatgtatatttgtgcatgatgctttcaccactttgtggttgttaacgattaaatcacacgttttattttctcacagctgtttgtgcagagcaagtgcgtgctgcctcagctacctctcctggatctgctgctgcagcagcgccgccggcggctgctcatcctcctcctcctcctccttcaacctcaagaggccgagctgctgctgcaactgcaactgcaactgctgctcctcctcctcctcctcatgtggggcggcgttaacgaagagtccgtgtcgctgccgccgccgcagctgctgctgccgtcgctgctgctgcggcggcgtcggcgtccgcgcgtgcgcgagctgcagctgctccccgccgtgcgcgtgctgcgcgccgccgtgcgcgggatgctcgtgccgctgcacctgcccgtgcccgtgccccggcggctgctcctgcgcgtgcccggcgtgcaggtgctgctgcggcgtccctcgttgctgccccccctgcttgtgatcgatcgatcgattgagcgaagctgcactgattggttaattaattagttctcgatgatgatcgatcgagctgcgcgcgtacttaattagctagctaggttctggtgttaattagttcctcatcgatgcatatgttgattgccttgctctgcttgcggttatctgtaatttggctttgctgccatgatgagtacgtgattgctgatttattttac

SEQ ID NO: 7 - protein, 232 aa, Oryza sativa Japonica Group
MAMAAAPRPKSPPAPPDPCGRHRLQLAVDALHREIGFLEGEINSIEGIHAASRCCREVDEFIGRTPDPFITISSEKRSHDHSHHFLKKFRCLCRASACCLSYLSWICCCSSAAGGCSSSSSSSFNLKRPSCCCNCNCNCCSSSSSSCGAALTKSPCRCRRRSCCCRRCCCGGVGVRACASCSCSPPCACCAPPCAGCSCRCTCPCPCPGGCSCACPACRCCCGVPRCCPPCL

SEQ ID NO: 8 - DNA, 2088 bp, Oryza sativa Japonica Group
aagagtgagtgtgtgtataatatgatagggtgtgtgtgtgtttttataagaacgactacgcgcatctctatatttcggtacatcccgggtatgccttctctaaaaatgtcttgtgctaaagttgaagacaacttctaaggaaggtatctctcatcttccttgtgtgtccctactagaaaatatttttacaggcggccaaaatatttttttttgcaggcgtccataacctccgcctacacccaaagtcatgcaaaaatcaataatttttgtaggtggctaaatccacccgtttgcgaaaatattttcagcgtaaagaaaattcgccgccctcagccctacccaccgccgccctccccttcggccggatctagggttatggttttgggaggaagagggaggggaggggagctgcgtcaccatcactgaatctggtaggtgagagcgccgccatgagctcaccggtgctgccgccgacctcctgcctacgtgccgccttctccgctgcaagtcgccgctgctgccctccccacgacacagctggatccgggaggggagggcagggaaggttcgctgtcgccgccgccaccctccctacgacgtagccagatatgggtggagaggtaagcgccgccgccgctgcacaacccacgatgccgccgctgcacaacccgcgatgccgtcggccggatttgggaggtggagcgtcgccgccctccgccccgcgccatgtctgaggaaagagagcgatgggagcgccgccggccaccaccgtccccccttccccctccaaccagatctgggaggaagggagggagggaggggagccatcacgtcgttgggagtagatgccgccaccgccctccccctccctgcggccaccacactggggtgcaccgccaccgctaggtagccgcctctggctggatccacgccgaggagaggaaggagagggagagggagagggaggggaggggagatgtggaagttgacttagaaaattttgacgcccggtggtttttaagatactttacctttttgcaggcggatttattaaagaggtccgtctgcaaaaataatgatattttcacggtcggacctcttaagatatctacatgtagaaatctatatttttttacttaaattactgccagggctttgcctcgtagtataattttcataaaaactcaaaatatttacaaattacaaaagaggaaggaaggagaaaaacttataaagattacaatgtttgtaaccaatcaaaaactatctgctttaaaggatctttcattctacacatatgaagaagaacttcttttctaaacgatattcttcatgaaccaaaggagggaagctcattccgaaaatttttcccatttctctgctcgtaggcggataactatctcatctcacggttgttatttttgtaggtggctatttggcttccagagacctactcgtccgggaaaaagaaatgccagcatctagaaaaatagtttttctagtagagtgttgtgagcgtctgcgatcgtggtaaagaaagcaaaaaaggtgaaggacgagtggcatgatacatatgggaaagctgtagactttgacccttgactactcgttggaagtgtgcgtctgcatgcattattgaacggctctgatccccgcggcgcagcggatcggggtcatgtccggatgggcatatcgacgagaaggatccgtccccgacaatctttcaaggcccgtgcccccgtccctcctctcctctgcgcctttccatcatcatttacgcccaaccccaacacatgtacatttcccttggcttgcttccggagaagaaaagagcggccatccactccactctccactctctcccttccatcattacttgcccaaaaacggcaatcccctcccctccatctccatgtgctcttccacctagctccgccattcaaagcaaagcaccaagcttttgcctctccctctaccatgcctgccccctatacatagctgctgcaccgtctctcttcataaatatactagtaggagtagcagagctcatcacttcgatcatctccattatcggaacttcggagtgac

SEQ ID NO: 9 - DNA, 3144 bp, Cucumis melo
atggctggaaaacttctacactccttggcagatgacaatcctgatttgcgcaagcaaataggatgtatgactggtattttcaacctatttgatcgtcacaatgcgatcaccacgaagcgaattagtcacaagaggcttcctcctggtcattcccaatcaaatcctggcgagttggttggtactgtacatcaagagaaaccaaatgagtcaagtctgaatgagaatgtgaataacaagcaaagcatgcctgcagaatcatccagagactctctctcctcctgttcatcatctttgtcctctatggactgcaataaaactacacaactagaagccttgtccttttccaggaccaatattgttgaaagtccctcaatagggttgccattggaccccttgaatacctataactattcagagaggcacccattcaatatcaaacatgtagtacaagattctatgcatagagaagtaagaacatcatttgttaaaatgacagacgatgatgactttggttataatgtaaaacatagagactctccaagaccccctccaatgtccaaatgtgcagaagtttcttcaagggttgcaagaagacataaacaagatgttccaattgatattgaggaatcttttagagttctcgctaaactaaaagatgcatcctggaacttcaatcaagctacgagatgtccaacatcagcatgtgaaactgaagcaacacatgaaaagaatttactttcaagggatttgcggcggctttcttatgatggtagagaaagaagtcaatcctcctttgaatcaagaaaccccaagtcaagccctaaactgaaagagctccctagactatcactggacagcagggagacttctgcatgtaggaattttcaaaatactagcggctctactgatgaatcccccgatctacatcattcttctggcaatcagaagcggctgcctagtgttgtagcaaaattgatgggtctagaaacattgcccgatacattttcgactgcagatactcaatattgtggtgaaactttgacaaaatcattagaatctagaaaactgaaaatatctgcctccgacaaaagcttatctaaatgcccaacttcaccaaggcgaaaaaatcatgatttgattaggaaacctattcaaacttctaggctccctgttgaaactgcaccttggaggaagctagatggaactcgagttactaaaagcatagctcttaggcatgtaaaaagtccaggaccaagctccacccctgcagttcatggtgaagtcgagatgaagctgaaagatcttgaatttgaacaatccagtaaggatctgagatcacttaaaaaaatacttgaggcaattcaaagtagggcactatcagaaattgaaaacggagagcgaacttcagtttttggaattcaaaggaaccaagaaccaatttcttctagtcccaatcaaaaaaccaggttgatgagccagcgaaacagacggagcagtgtagttgttacctccacttcttgtgcacctaattattcaaaggcatatgaacctccaattatcatcatgagacctgctaaacctgttgaaaaatcagttatatcaaccccagtgattcaaatggatcgcttccctgttccccataagcttcaaaatgaaggatttgaggataataaaaagggctctaacaatggcgaaaccagagcacgcgttcctaaaagcacacagaagaagcttgctgtcattacccccgagaagaagtcaatttctagaaatatacgatcgcctcaaacttcttcaaaacctcaacttgcacctaaagaaagaaacaaaaactcaataaaaagttcagattctgttagtccaagactgagacatgggaagtttgaggtggagaaacgatctcatccccctaaatctgatgcaaacaaatccaaaaggagaatgaagcagacagattcgagttcacactgtggaaagataaaacccacgtcttccaatataagacagtgtgatgatccatcgagtgaaatgagcaatgaaccaggaattctgagttaccaaagtgatgacatgacccaacgatcagatgctagtttatccttggattcaaagatggatgttgaggtgaccagcagcacgcaatcaaccgagattgatgacagccaacaagccacggagactgttgaactcttaacaccttgctcagttaaaaagttatcaatggtggccagtagtgaagatgggtcgacggtagaacaagatgcaatagcactagagcatcccagtcctgtctctgttctcgatggctcgttatatagagatgatgaagcatctcctgtgaaaaaaattacgatttcacttcatggtgatgaatcactagattctattgagaggcgcagtgaagaccagtgcaacatttcagatgacatctttgtaaatcctttggttttaaatcataatgtggagatagacagtatgaattttgaaaatattggagatctgattcggaagtttggccatttgaactcgcatcatgatgaaggagaaaaagattataaccgattgttgtgtgagaatactagtccagatcacatatacatatcggagatactattagcttccggtattctactccgagatctaggctctgacctgaccacatttcagcttcatccttatggtaatcccatcgatcaagagttattcttcgttttggagaaaacaaaggtgggtggcctactgccgaaagaagggttcagcccagcaagagcttcctattcaaacagggagaaatttgataggaagctcatatttgatgctgtaaatgagatactaagtgaacatttggctctcattgatggtggttctcctgagccatggttgaaaccaacaaagattgcaaaagaagcttttagcgggcaaaagattttgaagcatttgtgtaatgaaatagaacagtttcaagctaagaagttcagatgcaacttcgacaacatgaaggatgactcaatgagcattctgcaagacgatttgatgcgccaatcaaggagttggacaaatttccaaggtgacgtctatgatgttgtgttagatgtcgagcggtcaatattcaaagacttggttaatgagatcattgtttggtga

SEQ ID NO: 10 - DNA, 5167 bp, Cucumis melo
ctctctctctctctctctctctctctctctctctctctctcttctcgttattgttttattttgttgaccagtcttctctgattgttatacaattcatgctttcttctacctgttttatattcacttatagtaatacattcaattgtaggacgccgggagaaaattcctattaccggttttctctttgattctttttcccattataagtaattgctgatactttgaatgttctgtatttgccttcgaaatcagatgattcttgttttgtttctgggtctcttcttctacttggtttgattctctagaggtgtcgtctttcttttgttgctttgaagtattatgatattgggagtattccatgccatacccaattggtaaattttgtgggatcaagatttgcattgcaaaatcagtgtggtgtgatctgagagagattggtgttttgagaagtaattagctggaaaaagatctgttgatttaatacatggtataaacaaggaagtatttcaaattttattatatacagcctttactctttccattttgagactgataggggagtatagattatgcttaaacttctcatatttaaggcgaggcacgaaaaagagaaggaattcagattcttgttgagcactccagtcccagaaactgatgtgttgatttattctgggatcataatgaagctcagaattctcaatatcgagactcaaaaggcacaagtttttgatatggaagttcaatcttagaggtctaaggagaaacttttggagtgtaatttgttagtcatttgagaagtgaatagtagatatggctggaaaacttctacactccttggcagatgacaatcctgatttgcgcaagcaaataggatgtatgactggtattttcaacctatttgatcgtcacaatgcgatcaccacgaagcgaattagtcacaagaggcttcctcctggtaattatctaaactatgtttacttcttgtaactgtcgttttacaatcatcttttttgcttatcccgtggacttttatgtgttcaacatttgattttcattcttatttccattttctctcttaacaatgcatcattggttttgaatgttcctttccatgtcgaagagtcctaattggcctcaaaagaaggaagtaaggtttaataatctgtatgtctgtccgtcagattttttttgcaatcaaatgctgaattgcttattttcgtaaatatgccaaatacatcatgaaaaccatggaaaagataataaaagaaatacttcaattactacttctggtttgaagtttgaactcccattcatgtttttactggtaatcgtgtatggaactatgtggcattgactatgggtattgtttaaaggcatttcgagtcacagtgttcctcatccatatgccattaaatcattctctagtttttttttcgtttctatttttttcctccgcttttacaaacttttgaactctatacgtcactcaatatctaatcttgtcttgtacaggtcattcccaatcaaatcctggcgagttggttggtactgtacatcaagagaaaccaaatgtaagagcctaattttcttatgccaacttttcttttgatttgatagcaacagaagcattcgttggaaagatacttttgcaatcaattcaaacatcacctcactcctgacttattactcgaatcccatcttgattctaatattaaaactagttatattgcatgcctatttgtgtaaatgatgagatttaaagttatttcataacaggagtcaagtctgaatgagaatgtgaataacaagcaaagcatgcctgcagaatcatccagagactctctctcctcctgttcatcatctttgtcctctatggactgcaataaaactacacaactagaagccttgtccttttccaggaccaatattgttgaaagtccctcaatagggttgccattggaccccttgaatacctataactattcagagaggcacccattcaatatcaaacatgtagtacaagattctatgcatagagaagtaagaacatcatttgttaaaatgacagacgatgatgactttggttataatgtaaaacatagagactctccaagaccccctccaatgtccaaatgtgcagaagtttcttcaagggttgcaagaagacataaacaagatgttccaattgatattgaggaatcttttagagttctcgctaaactaaaagatgcatcctggaacttcaatcaagctacgagatgtccaacatcagcatgtgaaactgaagcaacacatgaaaagaatttactttcaagggatttgcggcggctttcttatgatggtagagaaagaagtcaatcctcctttgaatcaagaaaccccaagtcaagccctaaactgaaagagctccctagactatcactggacagcagggagacttctgcatgtaggaattttcaaaatactagcggctctactgatgaatcccccgatctacatcattcttctggcaatcagaagcggctgcctagtgttgtagcaaaattgatgggtctagaaacattgcccgatacattttcgactgcagatactcaatattgtggtgaaactttgacaaaatcattagaatctagaaaactgaaaatatctgcctccgacaaaagcttatctaaatgcccaacttcaccaaggcgaaaaaatcatgatttgattaggaaacctattcaaacttctaggctccctgttgaaactgcaccttggaggaagctagatggaactcgagttactaaaagcatagctcttaggcatgtaaaaagtccaggaccaagctccacccctgcagttcatggtgaagtcgagatgaagctgaaagatcttgaatttgaacaatccagtaaggatctgagatcacttaaaaaaatacttgaggcaattcaaagtagggcactatcagaaattgaaaacggagagcgaacttcagtttttggaattcaaaggaaccaagaaccaatttcttctagtcccaatcaaaaaaccaggttgatgagccagcgaaacagacggagcagtgtagttgttacctccacttcttgtgcacctaattattcaaaggcatatgaacctccaattatcatcatgagacctgctaaacctgttgaaaaatcagttatatcaaccccagtgattcaaatggatcgcttccctgttccccataagcttcaaaatgaaggatttgaggataataaaaagggctctaacaatggcgaaaccagagcacgcgttcctaaaagcacacagaagaagcttgctgtcattacccccgagaagaagtcaatttctagaaatatacgatcgcctcaaacttcttcaaaacctcaacttgcacctaaagaaagaaacaaaaactcaataaaaagttcagattctgttagtccaagactgagacatgggaagtttgaggtggagaaacgatctcatccccctaaatctgatgcaaacaaatccaaaaggagaatgaagcagacagattcgagttcacactgtggaaagataaaacccacgtcttccaatataagacagtgtgatgatccatcgagtgaaatgagcaatgaaccaggaattctgagttaccaaagtgatgacatgacccaacgatcagatgctagtttatccttggattcaaagatggatgttgaggtgaccagcagcacgcaatcaaccgagattgatgacagccaacaagccacggagactgttgaactcttaacaccttgctcagttaaaaaggtatccttcttgtgttggttttcttttcattcatcttttaaatgctcatcactaagtaatatttttgcttgatcagttatcaatggtggccagtagtgaagatgggtcgacggtagaacaagatgcaatagcactagagcatcccagtcctgtctctgttctcgatggctcgttatatagagatgatgaagcatctcctgtgaaaaaaattacgatttcacttcatggtaaactccagttattctaaccatctgcggcagctgctttgtcaaaagttattaggccaattaaactgccttggtagttttatttgtttcatctgattttgctctatgacttggtgtctcgtaggtgatgaatcactagattctattgagaggcgcagtgaagaccagtgcaacatttcagatgacatctttgtaaatcctttggttttaaatcataatgtggagatagacagtatgaattttgaaaatattggagatctgattcggaagtttggccatttgaactcgcatcatgatgaaggagaaaaagattataaccgattgttgtgtgagaatactagtccagatcacatatacatatcggagatactattagcttccggtattctactccgagatctaggctctgacctgaccacatttcagcttcatccttatggtaatcccatcgatcaagagttattcttcgttttggagaaaacaaaggtgggtggcctactgccgaaagaagggttcagcccagcaagagcttcctattcaaacagggagaaatttgataggaagctcatatttgatgctgtaaatgagatactaagtgaacatttggctctcattgatggtggttctcctgagccatggttgaaaccaacaaagattgcaaaagaagcttttagcgggcaaaagattttgaagcatttgtgtaatgaaatagaacagtttcaagctaagaagttcagatgcaacttcgacaacatgaaggatgactcaatgagcattctgcaagacgatttgatgcgccaatcaaggagttggacaaatttccaaggtgacgtctatgatgttgtgttagatgtcgagcggtcaatattcaaagacttggttaatgagatcattgtttggtgaagcagaattttggaagacaaaactataggggtatgcattggctagttttgcttgcattcctactagttttccatccttgatatttgctgtcttacagtgaaaacataaacatctgctctttcatcccctaattttttggtgtaaagctcaataatttgtgataattagttctgagctggttggttgtgcaatatacttgaccacaagaatcaaaatcaatgaaaatactttgttcctatttcattctttca

SEQ ID NO: 11 - protein, 1047 aa, Cucumis melo
MAGKLLHSLADDNPDLRKQIGCMTGIFNLFDRHNAITTKRISHKRLPPGHSQSNPGELVGTVHQEKPNESSLNENVNNKQSMPAESSRDSLSSCSSSLSSMDCNKTTQLEALSFSRTNIVESPSIGLPLDPLNTYNYSERHPFNIKHVVQDSMHREVRTSFVKMTDDDDFGYNVKHRDSPRPPPMSKCAEVSSRVARRHKQDVPIDIEESFRVLAKLKDASWNFNQATRCPTSACETEATHEKNLLSRDLRRLSYDGRERSQSSFESRNPKSSPKLKELPRLSLDSRETSACRNFQNTSGSTDESPDLHHSSGNQKRLPSVVAKLMGLETLPDTFSTADTQYCGETLTKSLESRKLKISASDKSLSKCPTSPRRKNHDLIRKPIQTSRLPVETAPWRKLDGTRVTKSIALRHVKSPGPSSTPAVHGEVEMKLKDLEFEQSSKDLRSLKKILEAIQSRALSEIENGERTSVFGIQRNQEPISSSPNQKTRLMSQRNRRSSVVVTSTSCAPNYSKAYEPPIIIMRPAKPVEKSVISTPVIQMDRFPVPHKLQNEGFEDNKKGSNNGETRARVPKSTQKKLAVITPEKKSISRNIRSPQTSSKPQLAPKERNKNSIKSSDSVSPRLRHGKFEVEKRSHPPKSDANKSKRRMKQTDSSSHCGKIKPTSSNIRQCDDPSSEMSNEPGILSYQSDDMTQRSDASLSLDSKMDVEVTSSTQSTEIDDSQQATETVELLTPCSVKKLSMVASSEDGSTVEQDAIALEHPSPVSVLDGSLYRDDEASPVKKITISLHGDESLDSIERRSEDQCNISDDIFVNPLVLNHNVEIDSMNFENIGDLIRKFGHLNSHHDEGEKDYNRLLCENTSPDHIYISEILLASGILLRDLGSDLTTFQLHPYGNPIDQELFFVLEKTKVGGLLPKEGFSPARASYSNREKFDRKLIFDAVNEILSEHLALIDGGSPEPWLKPTKIAKEAFSGQKILKHLCNEIEQFQAKKFRCNFDNMKDDSMSILQDDLMRQSRSWTNFQGDVYDVVLDVERSIFKDLVNEIIVW

SEQ ID NO: 12 - DNA, 3276 bp, Cicer arietinum
atggctgcaaagttgttgcattctttagcagatgacaatcaagatctgcagaagcagataggatgtatgaccggaatttttcaactctttgatcgtcatcagattgttaccggtcgtcgcattagccagaagagacttccttctggtaatttgcaattcagtgatgacagcttggaaagagattctgatagcatccgacatcgacaaatggcaaatgatacgagcttaaacagaggtcagaatgaaaagcaaagaatttcaacagaatcatcgagagcatcattctcttcttgttcatcatcggtttcttctctagactttaaggctgaagtagagacttcctttgacaggattattttgcctgaaactccttcaagggaaacagttatgaaccaaccaaatgtctctcctcgtttaggacgtcactcacttgacctgcgtgatgtggtgaaggattcaatgtatagggatcctcgagggatgtcttcgaaatctatggccaaagagcaatcttctgttcatgcattgaagcacaggggttcaccgcgacctcctcagctttccaaatatgttgatagatcttatggagttgaaatagatgcaaagcaaagtgcgcctattgatctaaaggagtctatccgagtcctttcgaaacttagagaagcaccttggcattatgctgaaactcgagaactaccaagatcatcacatgaagtaaaagacggacactggcattccatctcaaaggatgtcactccttggttagcttacgatggaagagaaacgagtcgttattcttttgaatcgcgagagaccataaaatccacaccaaagctaaaagaggttcctaggcattcacttgatagtaaggaaggtccgtggcgcacttatagttctgattcaaagccgagtcacatctcaagaaacgtttacagtggcacctccaccacaaatgaaaaattctctagtctacaacagtctccaccaactcaaagtcggctaccgagtgttgtagcaaagctgatgggcttggaagcgttacctgattcatctttaactggtgatactcaatcaggttcaactgaaacttattcagctcaagattatggtcagtttccaagatcatcaaaaactggattcataaggccactccgagtttctaactctccgaaaatctcattgaaagatccaacttccccaaggcggaagaatcaggacgtggttatgaaaccggtctctagttcaaagtttccgattgaaccagcaccatggaagcagcaggatgcaaatagaaactctcagaaacaaaatttaaggacaacaaaatctcctacagcaaaaacgcaagattcgtttccttcggtttatagcgagatagagaagagattgaaagaccttgaatttaaacaatctggaagggatcttagagcactaaagcagatactagaagcaatgcaagaaaaagggctattagagagtcgaaaagaagaacaagttccgaaccttgttggaagtcaaagtgactatgaacctaaagctatcaatcaaattcagaattctcggtcagtaaagcaacaaaatccccagagaaacaattttctatcttctacaatcaaaggaacagactcaacaagggtttttgattcaccaatagttataatgaaaccggcaaaacttgttgagaaatccgagttttctgcgtcttcagctattccaattggtggcttttctggttccaatagaaacaacatatcttctactctagtaacaaaagaacagtctcctaagaatattcgcagggacgcttctccggtttccattgataagaaaacaagtattaccaagagtactacaagatctgcacaatctcaatcaaggtctcaacaattttcaaaagaaaataaccaaagtccggtgaagaattcaggatcagtgagtccaagattgcaacagaagaagttggagttagagaagcgatctcgtgtgcctacgccgccatcggattcaatcaaatccagaagacaatctggtaaaaaggcagtggaatcagtttctccaggtggaaaagtaagacaaagagtccttaactcacagcctagtgaagagcaaatgagtgagttaagcaatgattctagaagtttttgtcaaggggacgaaatttctcttcaatcctacagcatcacggttgactcaaaattcgatattgaagtcactagtagtttacagtctactgaaattgatgacaaccaaagtccatctttgaagccaatgaaacaattagtttcagaaacagttcagaaaaaatcaactccaagattggatgagggtgagacaattgcagaacttgcaactaaggcgccagaacatctgagtcctatctcagttctcgatggatcaatgtacaaagatgatgagtcatccccggtaacgcggatacctaaagatccaaaagctggtaatgctcaagaatccaaagacaatgaggtcaaagatcagtggaaacctgatgacggcctttcatttaacaccgcaggatctggagagatcaaccgcaagaaactacaaagcatagaccaccttgttcagaagcttagaaggctgaactccagccacgacgaagtgagaatcgattacattgcttccctctgtgaaaactcaaatccagaccagagatacatatctgaaatactactagcttcaggtctcttactcagagacctgagttctgaatttctgacgcttcaacttcattcatcgggtcatcctattaacccggagttgttcctcgtcttggagcagaccaaagcaagtagtttggtttcaaaagaagaaagcagcttcgaaaaagctgctttctcgaagctaaatactgagaaatttcaccgaaaactcatcttcgattctgtgaatgaaattcttggtgcaaaactagactattctctggagccatggtttcaacctaacaaactcacaaagaaaacactcagtgctcaaaagcttcttaaagaactatgcttcgagatagaaaaagttcaaaccaaaaaagctgaatgcatcttagaagatgaagaggatgatggtttaaagagtatgctttgtgaagatgtgattcatggatcagaaaattgggaaaatttcaatggtgaaatacctggaattgtattggatgttgagagactgatatttaaggatttggtaaacgatattgtgatcggtgaagcggctggtttgcgagttaagtcatcggttaggcgtcggaaactatttggaaagtag

SEQ ID NO: 13 - DNA, 5576 bp, Cicer arietinum
ccagattgtttagcagatttttatgacacaacccacacacaaaaaaaaaagaaaactaagaaaacaaaattgacccttacttttctattcctttgcttccattaagatatcatttgtgggttttttgttctttggcattgacattggtttcacttttggtggtttgagtcattgttcatttgcttaaaggggtgttaagttcctttccttatttgtaccatttgttgccattgtcacataatctattgtctggtttgttttttgaaacctaacaaggttcttgctttcatccaaatgaaaaccctttgattaggcttttttgggttataccctttttcatttcacagttttccattggcttcttgcaagttttgactgagagaaggttttggatgagttttgaactaaccccacaaatttggattattagtttaaggctttttagagcacaaagtttgaatttttcttatgtttatgagaacccaaatctgtgttgagtttgataaagtttgatacagtcaaagggtattttattttaatgatttaaaatgcctcaagaaattgtttactttgcaatttgttgacgcatttgtctttataatgagactacagaactgtgaaaactgttccattctcttctagctttgagggtgaaagaaaagaggttcatttacttgtataaagcatattgggttttattttcttatggtgtcgaaattttggattttgtgttgtattaggtgtaatagaatcataaattttactcataaggggtttggaatttgatgtattgtgtaagaagatttgacttttgagagtattatagatcacacatattttttatgaagagagtgttgtgctaatttattgtggtggttgagaatttgagcttaatttgtgaagaaaaaagggttgacatggctgcaaagttgttgcattctttagcagatgacaatcaagatctgcagaagcagataggatgtatgaccggaatttttcaactctttgatcgtcatcagattgttaccggtcgtcgcattagccagaagagacttccttctggtatttctcttagtagtaacttattcaattttaccgattctgtttgcaggaatgtgtttttatttcctttttgagatgatttttcatttgagctgttaactttactaattgagagtgtcaatctcttattactgttcgttgcatttgtttatagataacgatttttcaagagttaacatccaacttgtgtggataagtttgttatgttgtgtatatgatctatatgtttcagtttcattgtcgtatttgaatttaatgtttctgcttttccataggtaatttgcaattcagtgatgacagcttggaaagagattctgatagcatccgacatcgacaaatggcaaatgtaagaaccttgtttttaccctcattttttacaatttttataatgttttcagttctaaattgattgaataaagctttaaattgaggcacgattgttacaataccaagtatgcatatactgatcttatgatatattattcataacatatatgtgcatatttgactaccatttccattggagacaaatgtagaaggttgagaatgttttcataatctatagaatcattttctatatttatccatctcccgaatttccgcaaaatcaatcatgtttccatttttctcctgataaaaatttcacgtgcatatactttttatttttgatgtgtgtgtttgtaactatcaagccttataaagaaactacaagcatgtaaatgaaacatggcttataaagcatatttgattcattgcaggatacgagcttaaacagaggtcagaatgaaaagcaaagaatttcaacagaatcatcgagagcatcattctcttcttgttcatcatcggtttcttctctagactttaaggctgaagtagagacttcctttgacaggattattttgcctgaaactccttcaagggaaacagttatgaaccaaccaaatgtctctcctcgtttaggacgtcactcacttgacctgcgtgatgtggtgaaggattcaatgtatagggatcctcgagggatgtcttcgaaatctatggccaaagagcaatcttctgttcatgcattgaagcacaggggttcaccgcgacctcctcagctttccaaatatgttgatagatcttatggagttgaaatagatgcaaagcaaagtgcgcctattgatctaaaggagtctatccgagtcctttcgaaacttagagaagcaccttggcattatgctgaaactcgagaactaccaagatcatcacatgaagtaaaagacggacactggcattccatctcaaaggatgtcactccttggttagcttacgatggaagagaaacgagtcgttattcttttgaatcgcgagagaccataaaatccacaccaaagctaaaagaggttcctaggcattcacttgatagtaaggaaggtccgtggcgcacttatagttctgattcaaagccgagtcacatctcaagaaacgtttacagtggcacctccaccacaaatgaaaaattctctagtctacaacagtctccaccaactcaaagtcggctaccgagtgttgtagcaaagctgatgggcttggaagcgttacctgattcatctttaactggtgatactcaatcaggttcaactgaaacttattcagctcaagattatggtcagtttccaagatcatcaaaaactggattcataaggccactccgagtttctaactctccgaaaatctcattgaaagatccaacttccccaaggcggaagaatcaggacgtggttatgaaaccggtctctagttcaaagtttccgattgaaccagcaccatggaagcagcaggatgcaaatagaaactctcagaaacaaaatttaaggacaacaaaatctcctacagcaaaaacgcaagattcgtttccttcggtttatagcgagatagagaagagattgaaagaccttgaatttaaacaatctggaagggatcttagagcactaaagcagatactagaagcaatgcaagaaaaagggctattagagagtcgaaaagaagaacaagttccgaaccttgttggaagtcaaagtgactatgaacctaaagctatcaatcaaattcagaattctcggtcagtaaagcaacaaaatccccagagaaacaattttctatcttctacaatcaaaggaacagactcaacaagggtttttgattcaccaatagttataatgaaaccggcaaaacttgttgagaaatccgagttttctgcgtcttcagctattccaattggtggcttttctggttccaatagaaacaacatatcttctactctagtaacaaaagaacagtctcctaagaatattcgcagggacgcttctccggtttccattgataagaaaacaagtattaccaagagtactacaagatctgcacaatctcaatcaaggtctcaacaattttcaaaagaaaataaccaaagtccggtgaagaattcaggatcagtgagtccaagattgcaacagaagaagttggagttagagaagcgatctcgtgtgcctacgccgccatcggattcaatcaaatccagaagacaatctggtaaaaaggcagtggaatcagtttctccaggtggaaaagtaagacaaagagtccttaactcacagcctagtgaagagcaaatgagtgagttaagcaatgattctagaagtttttgtcaaggggacgaaatttctcttcaatcctacagcatcacggttgactcaaaattcgatattgaagtcactagtagtttacagtctactgaaattgatgacaaccaaagtccatctttgaagccaatgaaacaattagtttcagaaacagttcagaaagtaagagccattttatctcatttaaatcaaactttcttactataacaatatgattaaactttttaattttagcaatagcataatccttttatcagttaatactatgttgtttgattttacctaatattgtagaaatcaactccaagattggatgagggtgagacaattgcagaacttgcaactaaggcgccagaacatctgagtcctatctcagttctcgatggatcaatgtacaaagatgatgagtcatccccggtaacgcggatacctaaagatccaaaaggtagtttctgatttctatttatggataaaaagataggatccatattatctataaggaccacactttatattgagacactttttagatggacttatttgaacttatctacttccataagctcctgtgagactattttcgagagattaatgacatgttcataagttgtttcagtttctttccattagctctcctggatagcttatgaaaacaatttatgtaaactctaatagctctaatgactatttgcttaatatgcatattctggtatttgccctgaagatttgaccaatgcatcatagcatttaaagtcatctagaattattattattatttacttatctcattataacatcatattttgcagctggtaatgctcaagaatccaaagacaatgaggtcaaagatcagtggaaacctgatgacggcctttcatttaacaccgcaggatctggagagatcaaccgcaagaaactacaaagcatagaccaccttgttcagaagcttagaaggctgaactccagccacgacgaagtgagaatcgattacattgcttccctctgtgaaaactcaaatccagaccagagatacatatctgaaatactactagcttcaggtctcttactcagagacctgagttctgaatttctgacgcttcaacttcattcatcgggtcatcctattaacccggagttgttcctcgtcttggagcagaccaaagcaagtagtttggtttcaaaagaagaaagcagcttcgaaaaagctgctttctcgaagctaaatactgagaaatttcaccgaaaactcatcttcgattctgtgaatgaaattcttggtgcaaaactagactattctctggagccatggtttcaacctaacaaactcacaaagaaaacactcagtgctcaaaagcttcttaaagaactatgcttcgagatagaaaaagttcaaaccaaaaaagctgaatgcatcttagaagatgaagaggatgatggtttaaagagtatgctttgtgaagatgtgattcatggatcagaaaattgggaaaatttcaatggtgaaatacctggaattgtattggatgttgagagactgatatttaaggatttggtaaacgatattgtgatcggtgaagcggctggtttgcgagttaagtcatcggttaggcgtcggaaactatttggaaagtagttttttttctcttttcctttccttaatttctcactgatattagatctttatattcttgtcatttgcatatagtttattttcagtgtcacgccatatactatagagctacgattattattttttgtgtaaggtgtaaagaaatttgacttaccatggatttgtggaatacatactatataaaaactaaatctcttcatgta

SEQ ID NO: 14 - protein, 1091 aa, Cicer arietinum
MAAKLLHSLADDNQDLQKQIGCMTGIFQLFDRHQIVTGRRISQKRLPSGNLQFSDDSLERDSDSIRHRQMANDTSLNRGQNEKQRISTESSRASFSSCSSSVSSLDFKAEVETSFDRIILPETPSRETVMNQPNVSPRLGRHSLDLRDVVKDSMYRDPRGMSSKSMAKEQSSVHALKHRGSPRPPQLSKYVDRSYGVEIDAKQSAPIDLKESIRVLSKLREAPWHYAETRELPRSSHEVKDGHWHSISKDVTPWLAYDGRETSRYSFESRETIKSTPKLKEVPRHSLDSKEGPWRTYSSDSKPSHISRNVYSGTSTTNEKFSSLQQSPPTQSRLPSVVAKLMGLEALPDSSLTGDTQSGSTETYSAQDYGQFPRSSKTGFIRPLRVSNSPKISLKDPTSPRRKNQDVVMKPVSSSKFPIEPAPWKQQDANRNSQKQNLRTTKSPTAKTQDSFPSVYSEIEKRLKDLEFKQSGRDLRALKQILEAMQEKGLLESRKEEQVPNLVGSQSDYEPKAINQIQNSRSVKQQNPQRNNFLSSTIKGTDSTRVFDSPIVIMKPAKLVEKSEFSASSAIPIGGFSGSNRNNISSTLVTKEQSPKNIRRDASPVSIDKKTSITKSTTRSAQSQSRSQQFSKENNQSPVKNSGSVSPRLQQKKLELEKRSRVPTPPSDSIKSRRQSGKKAVESVSPGGKVRQRVLNSQPSEEQMSELSNDSRSFCQGDEISLQSYSITVDSKFDIEVTSSLQSTEIDDNQSPSLKPMKQLVSETVQKKSTPRLDEGETIAELATKAPEHLSPISVLDGSMYKDDESSPVTRIPKDPKAGNAQESKDNEVKDQWKPDDGLSFNTAGSGEINRKKLQSIDHLVQKLRRLNSSHDEVRIDYIASLCENSNPDQRYISEILLASGLLLRDLSSEFLTLQLHSSGHPINPELFLVLEQTKASSLVSKEESSFEKAAFSKLNTEKFHRKLIFDSVNEILGAKLDYSLEPWFQPNKLTKKTLSAQKLLKELCFEIEKVQTKKAECILEDEEDDGLKSMLCEDVIHGSENWENFNGEIPGIVLDVERLIFKDLVNDIVIGEAAGLRVKSSVRRRKLFGK

SEQ ID NO: 15 - DNA, 3153 bp, Glycine max
atggcagcaaagctattgcattctttagcagatgacaacccagatttgcaaaagcagataggatgcatgactggggttttccaactctttgatcgtcaccatattattcctcctcgccacattacccagaagatgcttcctccaggtaattcccactccaattatgacaacctggaaagaggttctaatagaatacaccaaagacaatcagcagctgatataaggggtgtgagtgaaaaacaaagaatttcaacggaatcatcaagaacctcattctcttcttcttgttcatcatcaatgtcctctttggagtataaagctcaagcaggcgctcccttcaaccggaatggttatcctaaaagtcctatgagggagccagttatgaaccaaacaagttcctctcccgatttaagatgtcagtcccttgatctgagggatgtggcgaaggactctatgtatagggaggccagaggactatctaaagaaaaggattccccaacacattttcagctgtccaaatccatcaaaggaaaacaaactcctattcatctaagggagtctctgagagtccttgctaaacttagagaagcacctcggcattatgttgaagctaaagaacttccaagattatcatatgaagtaaaaggacattggcattccatctcaaaggatgctcctcggttttcttatgatggaagagaaacaagtggtacatctttcgaatcacatgattcctttaaatgcccaccaaagctaaaagagcttgctagacattcacttgacagtagggaaggttcttggcgtgcatatggctctgattcaaaatccagtaacccctcaagaaatttcaatgcaggtgatgcctctacctcagttgacaacgtttctagtcgacaacaaccgtcagcatcccagagccggccacctagtgttgtagcaaaattaatgggcttggaagctttgccagaatcctataatgccagtgatactaactttagtttgagtgaaactggctcagctcaaggcaatgatcagtttttgaaaaatggactcgtcaagccacttcgagttcataattctcctaaaatctcattgaaagacacgacttcccctcgatggaagaatcctgacttggctgtgaaaccaatcttaagttcaaggtttcccattgaaccagcaccatggaagcagcaggatggaaaccaaagctctgagaaactaacttcccgggccataaaagctactgcaagatcaccagattcatttccatcagtttattgtgagattgaaaagagattgaaggatcttgaatttaaacaatctggaagggatctcagagctctcaaacggatactggaagcaatgcaagtaaaggggctgttagagaccagagaagaagaacaagctttaaatgttggaaataaaagagactatgaactaaatccgagtcttattcagcattctatatcagtgaggcaacaaacagccagggaaactgaatctgtaaaggctatagaatcaccaattgtgatcatgaaaccaggaaaacttattgagaaaagtggaatttctgcttcttcagtctttccaattggtgaactctctgattcccataaacttcggagtggtggtgtacatgcacatgataaaagggggacagcttccaatcaaatagcaaaagatcagtctcttagaaacagtcactggaatgctcctaccagttttagtgaaaagaaagaaaacagtatcaggactattaaatcagcacaatcccaaccaaggtctaaacaacttccaaaagaaaatagtccaagttcagtaaagaattcgggatctgttagcctgagaatgcaacagaagaagttagagtctgagaagcaatctaacctgcctaccccaccatccgattcaaataatcccagaaggcagtcctttaagcagccaacagaatcaggttctcccagtcaaaaactgagacctaaagttgctagttcacggtactgtgatgaccgacttagtgagactagcaatgaattgagaagtctaagtagtcagtgggatgaaatatctctgcaatcagacagtatcacagttgactcaaagatggatactgaagttaccagcagtttacaatctgctgaaattattgaaagccaatgctcatctatgaagcctattgagcatttggtttcaggatcaatgcataagaaatcaactctgaggtggaatgaggatgagtcaattgcagaacctgcaacatatgcctcagatcatccaagtcttgattcagtcgatgatgtctcggtatacaaatatgatatgccatccccagtaaagagtaaatccaatgctcctaaagctgataatgctcaagaaaataaagcaaatgataatacagatcagtggaaccctgcagatggtttcttcgttaacaacacgatcaactgcaagaaattgcaaagcatagattgtcttattcaaaagcttaggcagctaaattcgagtcatgatgaaactagaaacgattacatagcttccctttgtgaaaatacaaatccagaccacagatacattgctgaaatactattaacttcaggtctattattgagagctttgagttctgagttgctgacatttcaacatcactcatcaggtcatcccattaaccctgagttattccttgtgctggagcagaccaagttaagtagtttgctttcgaaagacaaaagcagatttggaaaagctgcttacatgaagctaaatacagagaagtggcagaggaaactcatctttgatgctgtgaatgagattcttggtgaaaaactaggctcttttcttgagccatgcttgaagcctaatgaactcgtagcaatgaaattcgtcagtgcacaaaagcttcttaaagaactttgctttgaggtacaaaaacttcaatatgtgaagccagattgtagcttagaagatgagggagatgaactgaaaagtatgctacgggaagatgtgatgtgtcactcagaaaactggacaggtttctcagttcaattacctggggttgtgttggatgctgagagacagatatttaaggacttaattgatgagcttgtgattgatgaaatggctagtttgcaagtgaaatccggtaggcacaggtag

SEQ ID NO: 16 - DNA, 5298 bp, Glycine max
tttttgcatcaaatatttattgtggccctgtaatttagcaatagtattattgtttatgtgtaagctgaggatggaaaaccaactttgtggatgctgaatatggaactatataacataaatgtggagacctgctccattgacttgtagttgtcttatgaaccgtgtcctggaattaacttctgagtgtaaaggaagagaaaggagcttcctttatatctttaagcacaatttggatggtaaggactaaggagtaaggacccttgtgagctgtctgaaatgctggattctatgttatattaattgttacttaatagaatctgcaaccttatcagaaagtgtttgcactttgcattgttgtcgtcttttgttagtggatttgagagtacaaatgatgaagcttttatgaagagggagtaattgtaattgattgtggtggttgagagaagttgagtttaattggagaagaagaggtagatatggcagcaaagctattgcattctttagcagatgacaacccagatttgcaaaagcagataggatgcatgactggggttttccaactctttgatcgtcaccatattattcctcctcgccacattacccagaagatgcttcctccaggtaatgttcaattttggtaatttagtttatgtgagcatggttttcataatttcatctttttttttcttcttttatctttctattttcccttcaccagtctcaaatatattattttttatcactagtgctgtttcctaatggttgatttatcacaaggatactaatctcatgtcagagtcttaggtttcaactccttttgtctgtgttggttccttttcaactttcttcttcatatgttcggaacactggaggggggttgtaatttttcaaattttagtagctgaggttggctctgcattcacgggatgagatgcttgtgataatcttatttaacaaatattgaagttcattcaatactttgtatcttgaagtagattagctcatgacctttgcaccacttagtgttggttcttggccttatggtcttatgtttccatttcattagagtattcaaacctaacgattctgctttcattataggtaattcccactccaattatgacaacctggaaagaggttctaatagaatacaccaaagacaatcagcagctgtaagccttcctttacccgtttaacatattatatactgttttacagtttaaaatttcttgaataatggaagttgttaccagaccaaaatttaggctaagaattgttcatcttcctcaaatttgtttcaggatttgctgtattctgtttattacttcctaattcagtggctgaagtttttttttttcccttgtgtgggcaatgtactgaaactaccatgttgtctgaacttctcgtatttgaatggaactaaacttatgctacttggtgagtttgttgcaggatataaggggtgtgagtgaaaaacaaagaatttcaacggaatcatcaagaacctcattctcttcttcttgttcatcatcaatgtcctctttggagtataaagctcaagcaggcgctcccttcaaccggaatggttatcctaaaagtcctatgagggagccagttatgaaccaaacaagttcctctcccgatttaagatgtcagtcccttgatctgagggatgtggcgaaggactctatgtatagggaggccagaggactatctaaagaaaaggattccccaacacattttcagctgtccaaatccatcaaaggaaaacaaactcctattcatctaagggagtctctgagagtccttgctaaacttagagaagcacctcggcattatgttgaagctaaagaacttccaagattatcatatgaagtaaaaggacattggcattccatctcaaaggatgctcctcggttttcttatgatggaagagaaacaagtggtacatctttcgaatcacatgattcctttaaatgcccaccaaagctaaaagagcttgctagacattcacttgacagtagggaaggttcttggcgtgcatatggctctgattcaaaatccagtaacccctcaagaaatttcaatgcaggtgatgcctctacctcagttgacaacgtttctagtcgacaacaaccgtcagcatcccagagccggccacctagtgttgtagcaaaattaatgggcttggaagctttgccagaatcctataatgccagtgatactaactttagtttgagtgaaactggctcagctcaaggcaatgatcagtttttgaaaaatggactcgtcaagccacttcgagttcataattctcctaaaatctcattgaaagacacgacttcccctcgatggaagaatcctgacttggctgtgaaaccaatcttaagttcaaggtttcccattgaaccagcaccatggaagcagcaggatggaaaccaaagctctgagaaactaacttcccgggccataaaagctactgcaagatcaccagattcatttccatcagtttattgtgagattgaaaagagattgaaggatcttgaatttaaacaatctggaagggatctcagagctctcaaacggatactggaagcaatgcaagtaaaggggctgttagagaccagagaagaagaacaagctttaaatgttggaaataaaagagactatgaactaaatccgagtcttattcagcattctatatcagtgaggcaacaaacagccagggaaactgaatctgtaaaggctatagaatcaccaattgtgatcatgaaaccaggaaaacttattgagaaaagtggaatttctgcttcttcagtctttccaattggtgaactctctgattcccataaacttcggagtggtggtgtacatgcacatgataaaagggggacagcttccaatcaaatagcaaaagatcagtctcttagaaacagtcactggaatgctcctaccagttttagtgaaaagaaagaaaacagtatcaggactattaaatcagcacaatcccaaccaaggtctaaacaacttccaaaagaaaatagtccaagttcagtaaagaattcgggatctgttagcctgagaatgcaacagaagaagttagagtctgagaagcaatctaacctgcctaccccaccatccgattcaaataatcccagaaggcagtcctttaagcagccaacagaatcaggttctcccagtcaaaaactgagacctaaagttgctagttcacggtactgtgatgaccgacttagtgagactagcaatgaattgagaagtctaagtagtcagtgggatgaaatatctctgcaatcagacagtatcacagttgactcaaagatggatactgaagttaccagcagtttacaatctgctgaaattattgaaagccaatgctcatctatgaagcctattgagcatttggtttcaggatcaatgcataaggttagaactatgatgatctcttttcattcaagctttctgattaaactgtatgagaaaattaaaaaaattagtagtgacattttccaattatcagttgatatatatattttatttaatttttcagaaatcaactctgaggtggaatgaggatgagtcaattgcagaacctgcaacatatgcctcagatcatccaagtcttgattcagtcgatgatgtctcggtatacaaatatgatatgccatccccagtaaagagtaaatccaatgctcctaaaggtaatatttctgtcttccaaataacaataaaaaaacaaagagacaggttatctctgaagtctgatgactatatttcatagagtccaataaaataagacaaattcttggtctagaaagtcagtccatccccaagattgattacaactttatgtttaaaagaactcttggtccttttctatttgaaatggttcctcatgtaagagattgaaaatccttttttatgatggattgagcactagagagttgatgttgatcatgtttatattgtataaatacgttaaaaaaaatgtcagatctgccacttagatatgatgatgcataattgtactccctttagccactgttttttctggtctgtagccagcctcattaagtaacgttcaaattgtatacgagacaaaaaatttctcaaaggcaattgtgatgagcatcaatttaaggtgccatgggcgtaatatgtattttctgaaaaattagccacaagtattcactagagaaagaaatttcaatttgcatttttcacatgtaaatgatgtaatagtctaatatacaatgtgcaagttttattcatttccgtacactctttacctataagctttatttctgcagctgataatgctcaagaaaataaagcaaatgataatacagatcagtggaaccctgcagatggtttcttcgttaacaacacgatcaactgcaagaaattgcaaagcatagattgtcttattcaaaagcttaggcagctaaattcgagtcatgatgaaactagaaacgattacatagcttccctttgtgaaaatacaaatccagaccacagatacattgctgaaatactattaacttcaggtctattattgagagctttgagttctgagttgctgacatttcaacatcactcatcaggtcatcccattaaccctgagttattccttgtgctggagcagaccaagttaagtagtttgctttcgaaagacaaaagcagatttggaaaagctgcttacatgaagctaaatacagagaagtggcagaggaaactcatctttgatgctgtgaatgagattcttggtgaaaaactaggctcttttcttgagccatgcttgaagcctaatgaactcgtagcaatgaaattcgtcagtgcacaaaagcttcttaaagaactttgctttgaggtacaaaaacttcaatatgtgaagccagattgtagcttagaagatgagggagatgaactgaaaagtatgctacgggaagatgtgatgtgtcactcagaaaactggacaggtttctcagttcaattacctggggttgtgttggatgctgagagacagatatttaaggacttaattgatgagcttgtgattgatgaaatggctagtttgcaagtgaaatccggtaggcacaggtagctatttggaaagttgttcattccatttgttccctattttcgtgaatccataatgcatcattttgttcatttacacataattttttgtatcaagccataaaagtttgcagattaagagctttgactatttttgctaaattgtgaagcaagtaacttgccatggattttacaccataa

SEQ ID NO: 17 - protein, 1050 aa, Glycine max
MAAKLLHSLADDNPDLQKQIGCMTGVFQLFDRHHIIPPRHITQKMLPPGNSHSNYDNLERGSNRIHQRQSAADIRGVSEKQRISTESSRTSFSSSCSSSMSSLEYKAQAGAPFNRNGYPKSPMREPVMNQTSSSPDLRCQSLDLRDVAKDSMYREARGLSKEKDSPTHFQLSKSIKGKQTPIHLRESLRVLAKLREAPRHYVEAKELPRLSYEVKGHWHSISKDAPRFSYDGRETSGTSFESHDSFKCPPKLKELARHSLDSREGSWRAYGSDSKSSNPSRNFNAGDASTSVDNVSSRQQPSASQSRPPSVVAKLMGLEALPESYNASDTNFSLSETGSAQGNDQFLKNGLVKPLRVHNSPKISLKDTTSPRWKNPDLAVKPILSSRFPIEPAPWKQQDGNQSSEKLTSRAIKATARSPDSFPSVYCEIEKRLKDLEFKQSGRDLRALKRILEAMQVKGLLETREEEQALNVGNKRDYELNPSLIQHSISVRQQTARETESVKAIESPIVIMKPGKLIEKSGISASSVFPIGELSDSHKLRSGGVHAHDKRGTASNQIAKDQSLRNSHWNAPTSFSEKKENSIRTIKSAQSQPRSKQLPKENSPSSVKNSGSVSLRMQQKKLESEKQSNLPTPPSDSNNPRRQSFKQPTESGSPSQKLRPKVASSRYCDDRLSETSNELRSLSSQWDEISLQSDSITVDSKMDTEVTSSLQSAEIIESQCSSMKPIEHLVSGSMHKKSTLRWNEDESIAEPATYASDHPSLDSVDDVSVYKYDMPSPVKSKSNAPKADNAQENKANDNTDQWNPADGFFVNNTINCKKLQSIDCLIQKLRQLNSSHDETRNDYIASLCENTNPDHRYIAEILLTSGLLLRALSSELLTFQHHSSGHPINPELFLVLEQTKLSSLLSKDKSRFGKAAYMKLNTEKWQRKLIFDAVNEILGEKLGSFLEPCLKPNELVAMKFVSAQKLLKELCFEVQKLQYVKPDCSLEDEGDELKSMLREDVMCHSENWTGFSVQLPGVVLDAERQIFKDLIDELVIDEMASLQVKSGRHR

SEQ ID NO: 18 - DNA, 2937 bp, Glycine max
atggctgcaaagcttcttcatacattggcagatgaaaactcggatctgcagaagaaaattggatgtatgaatgggattttccaaatctttgatcgacaccatattctcacaagccggcgtaaaagtcttactttaggtaatgcacatgtcaatagtatcaactttgaaagagactctgttgatgcaatttgtcagcaaagatcagcatttcagtgtcaggactcaaaccttgttagcagtaatggattgagcgagaaactaacgaggctatcaaccgaatgttcgagggtttctttctcatcatcgtgttcatcatcttccccgttgtcttccgaggtcaacagagaagttcagcctgagatttctgcggatgaccgagtcatttttccagaatctcctacaagtgatccagtgatgagccaaggaactggtgctcgtgtgggacttgaccttagagatgttgttagagattctatgtatagagaagctagagggctttctgatgtatgtaggcaaaacagaagagaggattctccaagaccctatggtttgaagcaatccaggcctgttgatttcaatgaatcctgcagagctctagccaaacttagaaaaacatctcatcactattacaatgaggttgacatgaaagatacatcccgttactatgttgattctcgcggaaagtcgaaatccgggaagaagctgaaagagttgcctaggctttcgttggacagtagagaccacgttgatctcaaatcaggtaataaactttctgaaagtttcagtagaagctctagcatgaacaaagtttcaggtagcccgaaacggcctcctagtgttgttgccaagctaatgggcttggaaacattaccgggttctcctttgagcagagacagattcaacatgtttgatgataacagtgatccattcgcaagatcattgagggaaaatagcctgaaccgttctcttcggttctctcctagctcgcccagaagcttaggaaaggaccctgctgcttcttcttcttctccaagatggagaagctctgagtttgttatgaaacccttatcaagtttgagatatcccattgaaccagctccttggaagcaaaccgagagaaaccggttttctcaaaagcaagcctgcaggtctgtgaaatctctgtcacagtcgatggagggaaaattgaaagatcttgaggttaaacattcgggaaaggatctcagagctcttaaagatatattagaggcaatgcaatcaaaaggtctctttgatactcgaaagcaacaacaatgctcaaacttggaagctcaaagagattacgaactggcagattctgcaacttctaagcatgattcaatagacctgagaaacccggtgattccatccaatatgagaggtccaattgtgataatgaaacctgccagacttgttgaaaaatctggtatcccttcatcatctctgattcccattcacagtctatccggtcttaataagacctgcagagaagaacctgtaaatgttagaagaagttcaacaagtagaaaggcagtaaaagatcgtagtcctggaaaccaaagagctgaaccatgtatcagttctgacaagaaatctagcagcagaaacgtgatgtcttctcaggtttacaaagaaagcacttcaaagaattcagggcctgcaagttcaaagttgcagcagatgaagcctgagcatgacaagcgttctcgaccaccagcctctccatctgattcaagcaaattaagaaaacaaataagccgacaacccgtggaatctactacttctcctggtgggaggcgtagtagacccagggatcagaggagcttgcagcaaaatgatggccaacttagccaaatgagcaataaatctaggactaaaatagaagccaccttgagtatcgaaaatggtggaaagagcccatctgttatagaggcagccaaagctgtagtctctaacttaatacagaataagtccagtccaacgtttagtgaagatggatcatcagaacatccaagtccagtttctgttctcaatgcagaaatctaccgagagatcgaaccatctcctgtgaaaatccaagctagtgaaggcagtgttaatggctctattaactcgggtgttgaacattgcgaggaggaccagtggaatccagcttatagcttctcaaagacaacaacaagcttttcgccagagatgaaccgaaagaagcttcagaatgttgagcatttggttcaaaagctaaaaagactaaactctagccatgacgaaaccagtcaagattacattgcatctttatgcgagaacagtgatcctgacaccgatcacagatacatttccgagattcttttagcctcgggtcttctcctcagagatcttggctcaggattaacaacttttcaactgcacccttcaggccacccaattaatccggagctgttccttgtgattgagcaaactaaaggatgcagcagtagcagcaatgaaaagatcaaccgcaaacttgtgttcgatgctgttaatgaaatgctcgggaagaagctagcttttgttgagagctatgtagatccatggatgaagcaagctaaagcgagaaagaaggtcttaagtgcacaaaatctgttgaaggaactatgttcagagatagagatactacaaaagcaagccaagaagagatcagaaaacttgttgttgttggaggaagaagaagaagaagaagaagatttcttgaaatgtatattggatgaagatatggcaatccaatctgagaaatggacagactttgatgatgcaatccctggtttagtgcttgacatggagaggcttctcttcaaagatctggtgaaagagattgtgcacggtgagattgatcggctgcaaggaaactcaaggagacagaaaacggttttggctgacgagtag

SEQ ID NO: 19 - DNA, 4419 bp, Glycine max
agaaccaggaggaaacattttgcagaggttctttattcttcttcttctttgcttggcgctttctttctttccctaaggttttgaatgtacattctctgatcagtgatcttcttctgggagattaagttttcagacaaaagagcttttgttctgtaataatggagcttgtcttattccttttggggttagtggggatttgagaatctaggtgttgaaaatagggtttaatagattcatatgtttctgctagcctagactctacccaatttaccacgtataagaaaaaagcgaatttttcattatgatagggatttaagctatgtaatttagctggagagcaatgggaaatggcgttcacattgagctttgtcagggcaaattttattggaatgtgaattgataaaagctggaaacttttggaattatatgaaatatggaaagtggcgtcgttctcgttattagttggttccatggtggttgctattgatagagatataacgaaagcttacgtttttcccaaattaggatttactggaagcacaataaagaagagttaagacactgtcactacagagagaagagttcaaattctctcctttttgttaccagtagcaagttccggcgccggagattcgccggagaaccctcctggtttcaggtgaacttctagctatttttcaccattcatggctgcaaagcttcttcatacattggcagatgaaaactcggatctgcagaagaaaattggatgtatgaatgggattttccaaatctttgatcgacaccatattctcacaagccggcgtaaaagtcttactttaggtaatcataatccaataacacttaagtaataaataatgcttaatgctctagatcgtgtctcttagtcgttgacttgtacatggctatatgggttacaacgttcttaatatgtatgtcttttacaatctttcttcttctttagctcggtttcttcatgaactataaaggtcttgtctgattcttctgtggtgactagaaaggtttgtcctttcttggctgaatcttatctgatttgtgaaatgtctgttagttttgttaaattgattttgagttttatgttgctttttttcttggtagcttttgacttctcttaaccttaagactattgaagtttcaagaatctgtaatgtttagggggtttattggcaaagataattttgttgatgtttttttttttttttgcaggtaatgcacatgtcaatagtatcaactttgaaagagactctgttgatgcaatttgtcagcaaagatcagcatttcagtgtcaggactcaaaccttgttagcagtaatggattgagcgagaaactaacgaggctatcaaccgaatgttcgagggtttctttctcatcatcgtgttcatcatcttccccgttgtcttccgaggtcaacagagaagttcagcctgagatttctgcggatgaccgagtcatttttccagaatctcctacaagtgatccagtgatgagccaaggaactggtgctcgtgtgggacttgaccttagagatgttgttagagattctatgtatagagaagctagagggctttctgatgtatgtaggcaaaacagaagagaggattctccaagaccctatggtttgaagcaatccaggcctgttgatttcaatgaatcctgcagagctctagccaaacttagaaaaacatctcatcactattacaatgaggttgacatgaaagatacatcccgttactatgttgattctcgcggaaagtcgaaatccgggaagaagctgaaagagttgcctaggctttcgttggacagtagagaccacgttgatctcaaatcaggtaataaactttctgaaagtttcagtagaagctctagcatgaacaaagtttcaggtagcccgaaacggcctcctagtgttgttgccaagctaatgggcttggaaacattaccgggttctcctttgagcagagacagattcaacatgtttgatgataacagtgatccattcgcaagatcattgagggaaaatagcctgaaccgttctcttcggttctctcctagctcgcccagaagcttaggaaaggaccctgctgcttcttcttcttctccaagatggagaagctctgagtttgttatgaaacccttatcaagtttgagatatcccattgaaccagctccttggaagcaaaccgagagaaaccggttttctcaaaagcaagcctgcaggtctgtgaaatctctgtcacagtcgatggagggaaaattgaaagatcttgaggttaaacattcgggaaaggatctcagagctcttaaagatatattagaggcaatgcaatcaaaaggtctctttgatactcgaaagcaacaacaatgctcaaacttggaagctcaaagagattacgaactggcagattctgcaacttctaagcatgattcaatagacctgagaaacccggtgattccatccaatatgagaggtccaattgtgataatgaaacctgccagacttgttgaaaaatctggtatcccttcatcatctctgattcccattcacagtctatccggtcttaataagacctgcagagaagaacctgtaaatgttagaagaagttcaacaagtagaaaggcagtaaaagatcgtagtcctggaaaccaaagagctgaaccatgtatcagttctgacaagaaatctagcagcagaaacgtgatgtcttctcaggtttacaaagaaagcacttcaaagaattcagggcctgcaagttcaaagttgcagcagatgaagcctgagcatgacaagcgttctcgaccaccagcctctccatctgattcaagcaaattaagaaaacaaataagccgacaacccgtggaatctactacttctcctggtgggaggcgtagtagacccagggatcagaggagcttgcagcaaaatgatggccaacttagccaaatgagcaataaatctaggactaaaatagaagccaccttgagtatcgaaaatggtggaaagagcccatctgttatagaggcagccaaagctgtagtctctaacttaatacagaatgtgagttgctcttttctcatgctactgctaaaatttttggtactttaaaaaagtttcaactgctaattctctacacatttgtttcttaactgctaattctctacacatttgttttttttttactcagaagtccagtccaacgtttagtgaagatggatcatcagaacatccaagtccagtttctgttctcaatgcagaaatctaccgagagatcgaaccatctcctgtgaaaatccaagctagtgaaggcagtaagacttctctttaagagtctatatacatctttattggaaaaatgcaaattgttttatgttttcaatcatcttgtaacaggtgttaatggctctattaactcgggtgttgaacattgcgaggaggaccagtggaatccagcttatagcttctcaaagacaacaacaagcttttcgccagagatgaaccgaaagaagcttcagaatgttgagcatttggttcaaaagctaaaaagactaaactctagccatgacgaaaccagtcaagattacattgcatctttatgcgagaacagtgatcctgacaccgatcacagatacatttccgagattcttttagcctcgggtcttctcctcagagatcttggctcaggattaacaacttttcaactgcacccttcaggccacccaattaatccggagctgttccttgtgattgagcaaactaaaggatgcagcagtagcagcaatgaaaagatcaaccgcaaacttgtgttcgatgctgttaatgaaatgctcgggaagaagctagcttttgttgagagctatgtagatccatggatgaagcaagctaaagcgagaaagaaggtcttaagtgcacaaaatctgttgaaggaactatgttcagagatagagatactacaaaagcaagccaagaagagatcagaaaacttgttgttgttggaggaagaagaagaagaagaagaagatttcttgaaatgtatattggatgaagatatggcaatccaatctgagaaatggacagactttgatgatgcaatccctggtttagtgcttgacatggagaggcttctcttcaaagatctggtgaaagagattgtgcacggtgagattgatcggctgcaaggaaactcaaggagacagaaaacggttttggctgacgagtagatattgatttatacaataagtcgtttttggattctctgtattctaaagcggtatatatataatacaagtcaatgttcatgacaacattctctttttcctatcccagaggccagaacattgtgttaattattaagacaacaaaaaagtgaaaacaccgtccaacatcagaagctaacacttct

SEQ ID NO: 20 - protein, 978 aa, Glycine max
MAAKLLHTLADENSDLQKKIGCMNGIFQIFDRHHILTSRRKSLTLGNAHVNSINFERDSVDAICQQRSAFQCQDSNLVSSNGLSEKLTRLSTECSRVSFSSSCSSSSPLSSEVNREVQPEISADDRVIFPESPTSDPVMSQGTGARVGLDLRDVVRDSMYREARGLSDVCRQNRREDSPRPYGLKQSRPVDFNESCRALAKLRKTSHHYYNEVDMKDTSRYYVDSRGKSKSGKKLKELPRLSLDSRDHVDLKSGNKLSESFSRSSSMNKVSGSPKRPPSVVAKLMGLETLPGSPLSRDRFNMFDDNSDPFARSLRENSLNRSLRFSPSSPRSLGKDPAASSSSPRWRSSEFVMKPLSSLRYPIEPAPWKQTERNRFSQKQACRSVKSLSQSMEGKLKDLEVKHSGKDLRALKDILEAMQSKGLFDTRKQQQCSNLEAQRDYELADSATSKHDSIDLRNPVIPSNMRGPIVIMKPARLVEKSGIPSSSLIPIHSLSGLNKTCREEPVNVRRSSTSRKAVKDRSPGNQRAEPCISSDKKSSSRNVMSSQVYKESTSKNSGPASSKLQQMKPEHDKRSRPPASPSDSSKLRKQISRQPVESTTSPGGRRSRPRDQRSLQQNDGQLSQMSNKSRTKIEATLSIENGGKSPSVIEAAKAVVSNLIQNKSSPTFSEDGSSEHPSPVSVLNAEIYREIEPSPVKIQASEGSVNGSINSGVEHCEEDQWNPAYSFSKTTTSFSPEMNRKKLQNVEHLVQKLKRLNSSHDETSQDYIASLCENSDPDTDHRYISEILLASGLLLRDLGSGLTTFQLHPSGHPINPELFLVIEQTKGCSSSSNEKINRKLVFDAVNEMLGKKLAFVESYVDPWMKQAKARKKVLSAQNLLKELCSEIEILQKQAKKRSENLLLLEEEEEEEEDFLKCILDEDMAIQSEKWTDFDDAIPGLVLDMERLLFKDLVKEIVHGEIDRLQGNSRRQKTVLADE

SEQ ID NO: 21 - DNA, 2448 bp, Brassica rapa
atggctgcaaagcttctacatacgttggcagatgaaaactcggatctgcagaagaagattggatgtatgaatgggattttccaactctttgatcgccaccaccacgttcgtaaaagtcttgctttaggtaatgcacatgtcaatagtatcaactttgaaagagactctgcgtttcagtttcaggacaccaacatcattaatgctacgagcgagaaactaacagaatcatcaagggtttctttctcatcctcgtgttcatcatcttcactgttgtcatctgagctcaacagagaagaaactcaacctgaaatatcaccctatgaccgtgtcatttttccagagtctcccacgagtgatccagtgatgagccgaggaaaagggtttgcttcacatatgggacttgatcttagagatgttgttagagactctatgtacagagaagtcagagcgctttctgaagtttgtagacacaagagaagagaggaggattctccaagaccttatggtttgaagcactccacgcctgtcgatttcaacgaatcatgcaaggctctagccaaacttaggacaacatctcagcgttgttacaacgaggttgacataaaagatgcatctcacaacaagttgaaatcagggaagaaggtgaaagagtctcctaagctttctttggacagtagagaccacgttgatctcaaagctggtgatagtaggcttagtagaagctctagcatgaacaaacggcctcctagtgttgttgcaaagctaatgggtttggaaacgttacccggttctccattgggctcaccaagaagcttggggaagggcatagcttcttcttcttcttcttcttcttcttctccaagatggagaagctccgagtttgttatgaaacccgtgtctagtttgaggttccccactgagccagctccatggaagcaaactgatagaagaagccttattaagaaaaagcaagcctgcaagcctgtgttgcagtcaatggagagaaggttgaaaggtgttgagtctaatcatcccaaaaaggatctcagagctcttaatgagatattagaggcaatgcagacaaaaagtgtgtttggttctagaaagcagccgcaatgctcaaactcaagaggtctacagaatcaggtgatgccgccatccactatgagaggacctattgtgattataaaacctgctagacttgttgagagatctggtattccttcatcgtctctgattcctattcacagtctatctggtcttaatagagaagaagaagaatctgtgcatgttaacagaaactcaactagtaagaaggcggcgaaagattgtagtatcagttctggtgatagcaaatctagtagcagaaacgtgcggtcttctcaggtttacaaagaaagcacaagtccaagactgcgtcatcaggtgaagaagcatgagaatgaaaaacgttctcggccaccaaccactccatctgatgcaaacaaatcaagaagacaaacaaaccgacaaccggaaggatctactactacttctcgtggtggtaggcatagacacagagctcagaggagcgtgcagcaaactgaagccactgtgatagtcaaacaagctactcaagaaggtgatggaaagagtcaaactgtaataaaggcagccaaaaccgtagtctctaacttaatgcagactgtgagtgatgaacattgcgaagaggaagagcagtggaatccagcttacagcttctcagagacaacaacagcaacaaccttttcaccagagacaaaccgaaagaagcttcagaacgttgagcacttggttcaaaagctgaaaagactaaaccctagccacgacgaaaccagccaagactacattgcatcgctatgcgagaacaatgatcccaacaccgacaacagatacatatccgagattctgctagcctcgggtcttctcctcagagacttaagctcagagtcaacgacgtttcagctgcacccttcaggccaccctatcaaccctgagctattcctcgttcttgaacaaaccaaaggaagaagccgcagcagtagcagtaatgagaagctcaaccgcaaacttgtgttcgatggagttaacgaaacgctcgtggagaagttaccttttaaagatccatggatgaagaggaaggtgttgagcgcgcaacagctattgaaagaagtatgttcagagatagaaacagtgaaaaagcaagccgagaaaagatcaggtaacttgttgttgttggaggatcaagaagaagacttcttgaaatgtatattggatgaagatatagctactccatctgagaaatggacagactttgatgatgtagtacctggtttagtgcttcacttagagaggcttctcttcaaggatttggtgaatgagatcgtgcatggtgagattggtcggctgcaactagttactgattcataa

SEQ ID NO: 22 - DNA, 3453 bp, Brassica rapa
aaaagataatattgtggatatgttaagtcttaacgagaagacagaagtcacatgcagagggagacatctaaagaacagagttttaacaaaccacatccacttgccacaacccccacctctcttctctctctaatctcaacatcgtttctaattctattattcatcagagaaatgttttgtattgttctctgagaggtaaaatacagagtagcattgggcagatattcctctgtcccctctgcctcttcgtcttctccttgggtttatcagttcctcagtatctaaaatactttctgtcttatcttcttggtgtttgtaagattcttcaatgtacgttttctgaatcttctctgcaatggcgttcacattaagctttgtctgtgccagttttattggaatctaaatgttgataaaaagttaaaactgttttggaattatatcaaaatatggaagatgcgtcactctcgttatggttctatggtggttggctgttgatggagatataacaaaaaaagactataacacactgtcaagttcagattctcttcctcactgaacttctttcaactaatcacatggctgcaaagcttctacatacgttggcagatgaaaactcggatctgcagaagaagattggatgtatgaatgggattttccaactctttgatcgccaccaccacgttcgtaaaagtcttgctttaggtaatcattacagcactaacaaatatattaattaattaatacttgtgctttcttagatcgtgtctcttagtcgttgacttgtacgtggccatatgttctaaactagtatgtctttttttttccatgttcttctctttcttaagctcctgtttcttcatgaactaaaaggtctggtctcattctttgtgaggtctaaaaggtctctagtttgtgtgtttgtgtggcgttttcttgttagaatttgactttctcttaaccttagactcttatgtttgtggagtctgtaatgtttagagtttatggaacaaagagagtttgatatgatcctattactcttttgatgttacttcttgttgttgttgcaggtaatgcacatgtcaatagtatcaactttgaaagagactctgcgtttcagtttcaggacaccaacatcattaatgctacgagcgagaaactaacagaatcatcaagggtttctttctcatcctcgtgttcatcatcttcactgttgtcatctgagctcaacagagaagaaactcaacctgaaatatcaccctatgaccgtgtcatttttccagagtctcccacgagtgatccagtgatgagccgaggaaaagggtttgcttcacatatgggacttgatcttagagatgttgttagagactctatgtacagagaagtcagagcgctttctgaagtttgtagacacaagagaagagaggaggattctccaagaccttatggtttgaagcactccacgcctgtcgatttcaacgaatcatgcaaggctctagccaaacttaggacaacatctcagcgttgttacaacgaggttgacataaaagatgcatctcacaacaagttgaaatcagggaagaaggtgaaagagtctcctaagctttctttggacagtagagaccacgttgatctcaaagctggtgatagtaggcttagtagaagctctagcatgaacaaacggcctcctagtgttgttgcaaagctaatgggtttggaaacgttacccggttctccattgggctcaccaagaagcttggggaagggcatagcttcttcttcttcttcttcttcttcttctccaagatggagaagctccgagtttgttatgaaacccgtgtctagtttgaggttccccactgagccagctccatggaagcaaactgatagaagaagccttattaagaaaaagcaagcctgcaagcctgtgttgcagtcaatggagagaaggttgaaaggtgttgagtctaatcatcccaaaaaggatctcagagctcttaatgagatattagaggcaatgcagacaaaaagtgtgtttggttctagaaagcagccgcaatgctcaaactcaagaggtctacagaatcaggtgatgccgccatccactatgagaggacctattgtgattataaaacctgctagacttgttgagagatctggtattccttcatcgtctctgattcctattcacagtctatctggtcttaatagagaagaagaagaatctgtgcatgttaacagaaactcaactagtaagaaggcggcgaaagattgtagtatcagttctggtgatagcaaatctagtagcagaaacgtgcggtcttctcaggtttacaaagaaagcacaagtccaagactgcgtcatcaggtgaagaagcatgagaatgaaaaacgttctcggccaccaaccactccatctgatgcaaacaaatcaagaagacaaacaaaccgacaaccggaaggatctactactacttctcgtggtggtaggcatagacacagagctcagaggagcgtgcagcaaactgaagccactgtgatagtcaaacaagctactcaagaaggtgatggaaagagtcaaactgtaataaaggcagccaaaaccgtagtctctaacttaatgcagactgtgagtgatgaacattgcgaagaggaagagcagtggaatccagcttacagcttctcagagacaacaacagcaacaaccttttcaccagagacaaaccgaaagaagcttcagaacgttgagcacttggttcaaaagctgaaaagactaaaccctagccacgacgaaaccagccaagactacattgcatcgctatgcgagaacaatgatcccaacaccgacaacagatacatatccgagattctgctagcctcgggtcttctcctcagagacttaagctcagagtcaacgacgtttcagctgcacccttcaggccaccctatcaaccctgagctattcctcgttcttgaacaaaccaaaggaagaagccgcagcagtagcagtaatgagaagctcaaccgcaaacttgtgttcgatggagttaacgaaacgctcgtggagaagttaccttttaaagatccatggatgaagaggaaggtgttgagcgcgcaacagctattgaaagaagtatgttcagagatagaaacagtgaaaaagcaagccgagaaaagatcaggtaacttgttgttgttggaggatcaagaagaagacttcttgaaatgtatattggatgaagatatagctactccatctgagaaatggacagactttgatgatgtagtacctggtttagtgcttcacttagagaggcttctcttcaaggatttggtgaatgagatcgtgcatggtgagattggtcggctgcaactagttactgattcataagctcgtgttttttatctctgtattctaaatatataaataatacaaagtcaaatgttatgaaaaca

SEQ ID NO: 23 - protein, 815 aa, Brassica rapa
MAAKLLHTLADENSDLQKKIGCMNGIFQLFDRHHHVRKSLALGNAHVNSINFERDSAFQFQDTNIINATSEKLTESSRVSFSSSCSSSSLLSSELNREETQPEISPYDRVIFPESPTSDPVMSRGKGFASHMGLDLRDVVRDSMYREVRALSEVCRHKRREEDSPRPYGLKHSTPVDFNESCKALAKLRTTSQRCYNEVDIKDASHNKLKSGKKVKESPKLSLDSRDHVDLKAGDSRLSRSSSMNKRPPSVVAKLMGLETLPGSPLGSPRSLGKGIASSSSSSSSSPRWRSSEFVMKPVSSLRFPTEPAPWKQTDRRSLIKKKQACKPVLQSMERRLKGVESNHPKKDLRALNEILEAMQTKSVFGSRKQPQCSNSRGLQNQVMPPSTMRGPIVIIKPARLVERSGIPSSSLIPIHSLSGLNREEEESVHVNRNSTSKKAAKDCSISSGDSKSSSRNVRSSQVYKESTSPRLRHQVKKHENEKRSRPPTTPSDANKSRRQTNRQPEGSTTTSRGGRHRHRAQRSVQQTEATVIVKQATQEGDGKSQTVIKAAKTVVSNLMQTVSDEHCEEEEQWNPAYSFSETTTATTFSPETNRKKLQNVEHLVQKLKRLNPSHDETSQDYIASLCENNDPNTDNRYISEILLASGLLLRDLSSESTTFQLHPSGHPINPELFLVLEQTKGRSRSSSSNEKLNRKLVFDGVNETLVEKLPFKDPWMKRKVLSAQQLLKEVCSEIETVKKQAEKRSGNLLLLEDQEEDFLKCILDEDIATPSEKWTDFDDVVPGLVLHLERLLFKDLVNEIVHGEIGRLQLVTDS

SEQ ID NO: 24 - DNA, 3078 bp, Brassica rapa
atggctgcgaagcttctgcattcattggcagatgatagtgcagatctgcagaagcaaattggatgtatgaatgggatttttcaaatctttgatcgtcaccatgttcttactggccgacgaaaaagtcttactttaggtaatggaaatgccattaacatcaattatgaaagagactctgttgatacaatttatcaacaaaaagaaacttttcaggactccaacattggtgggaatgtgaaagagaagcgaagggtttcaacagaatcatctagagtttctttctcatcttcgtgctcttcctccccatcgtcttctgagttcaatagaggagttcaacctgacgcttctgcgtatgaccgagctaattttcaagaatctcctacaagtgatcctgagatgactgaagggaatggattttcacatttgggacttgacctcagagatgttgtgagagactcaatgtacagagaagccagagggcttttgagtaagactccaatgactagagaggaagtagttagacagagcagacgagaggattctccaaggccttatggtttgaagcaatcaactcccatggatctcaatgagtccttcagagttctagcaagacttagagaaacatctcaacattataacgagcttggcatgaaagatgcgcctcgttactcagttgattctcatgatacgttgaaatccagacagaagctgaaagagttgcctaggctttcgctggatagtagagaacgagcgacgcgaaactccagtgttgatcccaaatcaagtaagctttcagaaagtttcagtgaaagctgttcaagcagtagcaagaaacggcctcccagtgttgtagcaaagctcatgggattggagacattgcccggttctccattgggtagagacattcatcagtttggtctgaacaaaaccaacatctctgaccaaaatgacgatccattctcaagatcattgagggagaaaaatctgaaccgtgcaatccgtttttctcctagctcaccgagaagcttggggaaggacccggcttctccaagatggagaaactctgattttgttatgaaacctctatcaaatacaagattccccgttgaaccagctccatggaaacacgctgatagaaaccgagttttgcaaaagcaagctagcatgcctgtgaaagcgaagccgtatgaagcacctaattttcctcctactgtgtacagtgaaatggagcggagattgaatgatcttgagttcaaacattctggaaaagatctgcgagcccttaaacaaatattagagtctatgcagtcaaaaggtttcctagatactgagaaacaacaacaatccacaaactttgcagttcaaagagattatgaaagagaaaattctgcaacttccaaccatgcaatgtcatccagaacgagagttcagtcttcttcatctaaccaggtatatcaatccccgattgtgattatgaaacctgccaagcttgttgagaaggctggtattcctgcgtcatcccttattcccattcacagcctaactggcatcaagaagatccgtagagaaaaacctgatgataaaggaacttcagcaagtaatagtaaacgggtgacaaaagattgtagtcctggaaaccgaagagctgaatcatgtaccagctcgtttgataagaaatctgacagcagaaatgtgcggtcttcttcaaaaaagcctcagcaggtttccaaagaaagtgcttcaaagagttcaggatctgtaagtccaagattacagcagaagaagcttgagtatgataagcgttcacggccaccaacccctcctgattctagcaaatcaaggaaaccgtcaaaccaacaacttgtggaatctacttctcctggtggcagacgtagacccaagggtcagaagagtttgcagcaagttgatgaccaacttagtcaagcaagcaatgaatctaggacgtcaagtcatggcatttgtactcaatccgaaacagaagcctctgcttgtgtagaaaaatctactgaagctgatggtggtaaaagtccatctgtaatcgaggcagccaaagctgtagtctctaacttaatgcagaataaatccagtccaaggtttagtgaagatggattgtcagctaacctttcactagttgctttggaacatccaagtcctatttctgttctcgacgcttcaacgtacagagagactgaaccatcacccgtgaagacacaaggtaatgttgcccatgattttggtgatgaaaattgtgaggaccagtggaatccagcatacagtttctcagaaaccacatcaagcttttcgccagagataaaccgtaagaagctacagaatgttgagcacttggttcaaaagctcagacgattgaactctagccatgatgaagccagccaagattatattgcatcgctctgtgagaacgcagatcctaccaccgatcatagatacatttctgagattctattagcctcgggtcttctcctaagagaccttggctcaggattgacaacgtttcaacttcacccttctggccacccaatcaatcctgagctgttctttgttcttgagcagacaaagggaagcagcactacgcatctgttacacaaagaagaaagtaaggttctgaaaaatgagaagctcaaccggaaacttgtgtttgatctcgttaatgagattctggtggagaaactagcgtcagttgaagccacgacgaatccattgatgaagtcatatgctaaggtgactaagaaagccgtgagtgcgcaacaactactgaaagaactgtgttcagcgatagaaacacagcaaaagcaagccacaaagagatcagaaaactttttattggaagaagaagacgacttcttgaaaagtatacttgctgaagatgtgacgattcgatctgggaactgggcagacttcagtggagaaatgtcaggattggtgctggatgttgagaggcttgtcttcaaggatctggttaatgaaatcgtgcatgcagagacaagccgtctgcaagcaaagtcaggaaggcgacgaacgctttttgctgaccagtag

SEQ ID NO: 25 - DNA, 5006 bp, Brassica rapa
aggagattcctttgttcctttctttctttaatctctcttcttcttgatttggcggtttctttgctttctgcaactctttcttttcattggttctgtagatttaaactcacacattccgtgttttaggacaacaaacttctcagacaaaaggggcacacatgttctagtgttctgtttatggtttagtagtttattgaagattggatctaattaccaaaagggtttttatctttctccctccttttgtcttcagtggaatctgggaatcttaggtttgtaaaaaggtttaaactttatttcctttttaagatccgtaggtttgattgctgttagtgtaggactcagattaatttaggggttttcttgagctttaattaagctggagaagacaatgggtttcttctgatttgaaatcttaaacggtttttttctacaaagagaagggctaaaattttggagttttatgaatatggaaggtgcgtcattctcgttatagttttaatggtggttactgtttgatgatggagaaagaaaaaaagaaagcttttaaagttatctcttccaaattattgcaaacacatcattgaggcataaagtttgggtttttgggaaatcagtaaaggggaacacatcatagaagaaagctttcaaagccaaaaagaaaaaaggagaagtctttttgaatctttaagtagaaagtttccggcgccggagaattgtttttgtgatctgtagaaaatggctgcgaagcttctgcattcattggcagatgatagtgcagatctgcagaagcaaattggatgtatgaatgggatttttcaaatctttgatcgtcaccatgttcttactggccgacgaaaaagtcttactttaggtaaattaataattactatatatttatattgtttgataatttaaacactctcttctgatctctatggttcgtgtccagtagtcgttgacttgtatatggtcacatatgttattcttacatccatgtgtttttgtatgtttattcttctctgtttttgttttggctctttatctgccaatggagtgattctttcattaaccaggtcttgttatagtctcagagatctaaagttatggttgttactttttctttctcagttgtgttgatctgccgaatcttttggttagatttaatttttcccttatggccggttttttcttgctagattttgacttttattaacctttaggctcatggagtttccaaccaaatgtgataaattcaagtttgactagcaggttcttgtaggttttattaaacgtctctctcaatgcgtaatcgggtgttccttgtttgagagttttgatatgatgctcatgcttgttttatgtgcttgttgcaggtaatggaaatgccattaacatcaattatgaaagagactctgttgatacaatttatcaacaaaaagaaactgtaagttggttcttttgccaaccatctacgatttcattcatatacagaggttttctataagatctaaggttcttgcatttcagtttcaggactccaacattggtgggaatgtgaaagagaagcgaagggtttcaacagaatcatctagagtttctttctcatcttcgtgctcttcctccccatcgtcttctgagttcaatagaggagttcaacctgacgcttctgcgtatgaccgagctaattttcaagaatctcctacaagtgatcctgagatgactgaagggaatggattttcacatttgggacttgacctcagagatgttgtgagagactcaatgtacagagaagccagagggcttttgagtaagactccaatgactagagaggaagtagttagacagagcagacgagaggattctccaaggccttatggtttgaagcaatcaactcccatggatctcaatgagtccttcagagttctagcaagacttagagaaacatctcaacattataacgagcttggcatgaaagatgcgcctcgttactcagttgattctcatgatacgttgaaatccagacagaagctgaaagagttgcctaggctttcgctggatagtagagaacgagcgacgcgaaactccagtgttgatcccaaatcaagtaagctttcagaaagtttcagtgaaagctgttcaagcagtagcaagaaacggcctcccagtgttgtagcaaagctcatgggattggagacattgcccggttctccattgggtagagacattcatcagtttggtctgaacaaaaccaacatctctgaccaaaatgacgatccattctcaagatcattgagggagaaaaatctgaaccgtgcaatccgtttttctcctagctcaccgagaagcttggggaaggacccggcttctccaagatggagaaactctgattttgttatgaaacctctatcaaatacaagattccccgttgaaccagctccatggaaacacgctgatagaaaccgagttttgcaaaagcaagctagcatgcctgtgaaagcgaagccgtatgaagcacctaattttcctcctactgtgtacagtgaaatggagcggagattgaatgatcttgagttcaaacattctggaaaagatctgcgagcccttaaacaaatattagagtctatgcagtcaaaaggtttcctagatactgagaaacaacaacaatccacaaactttgcagttcaaagagattatgaaagagaaaattctgcaacttccaaccatgcaatgtcatccagaacgagagttcagtcttcttcatctaaccaggtatatcaatccccgattgtgattatgaaacctgccaagcttgttgagaaggctggtattcctgcgtcatcccttattcccattcacagcctaactggcatcaagaagatccgtagagaaaaacctgatgataaaggaacttcagcaagtaatagtaaacgggtgacaaaagattgtagtcctggaaaccgaagagctgaatcatgtaccagctcgtttgataagaaatctgacagcagaaatgtgcggtcttcttcaaaaaagcctcagcaggtttccaaagaaagtgcttcaaagagttcaggatctgtaagtccaagattacagcagaagaagcttgagtatgataagcgttcacggccaccaacccctcctgattctagcaaatcaaggaaaccgtcaaaccaacaacttgtggaatctacttctcctggtggcagacgtagacccaagggtcagaagagtttgcagcaagttgatgaccaacttagtcaagcaagcaatgaatctaggacgtcaagtcatggcatttgtactcaatccgaaacagaagcctctgcttgtgtagaaaaatctactgaagctgatggtggtaaaagtccatctgtaatcgaggcagccaaagctgtagtctctaacttaatgcagaatgtgagttctgactctcatttatatttctttagtgttagatgacaaatttttttcacttagttctcacaaggtttgtttttattttgttttcagaaatccagtccaaggtttagtgaagatggattgtcagctaacctttcactagttgctttggaacatccaagtcctatttctgttctcgacgcttcaacgtacagagagactgaaccatcacccgtgaagacacaaggtaacaaagggattctatctctagtgtcctagtggtcatcaactatcacagtcataaaataagaacttgcaaacatcaaagtcactttaggattctatgaccaggagttaactcttacatttgtctgtagcttgtttagtttgggaaagtttctcttttacgatttttttccaatgtaaggattgggtgttcagttccttccatttttgactcagagctgatcatgtgataggtaatgttgcccatgattttggtgatgaaaattgtgaggaccagtggaatccagcatacagtttctcagaaaccacatcaagcttttcgccagagataaaccgtaagaagctacagaatgttgagcacttggttcaaaagctcagacgattgaactctagccatgatgaagccagccaagattatattgcatcgctctgtgagaacgcagatcctaccaccgatcatagatacatttctgagattctattagcctcgggtcttctcctaagagaccttggctcaggattgacaacgtttcaacttcacccttctggccacccaatcaatcctgagctgttctttgttcttgagcagacaaagggaagcagcactacgcatctgttacacaaagaagaaagtaaggttctgaaaaatgagaagctcaaccggaaacttgtgtttgatctcgttaatgagattctggtggagaaactagcgtcagttgaagccacgacgaatccattgatgaagtcatatgctaaggtgactaagaaagccgtgagtgcgcaacaactactgaaagaactgtgttcagcgatagaaacacagcaaaagcaagccacaaagagatcagaaaactttttattggaagaagaagacgacttcttgaaaagtatacttgctgaagatgtgacgattcgatctgggaactgggcagacttcagtggagaaatgtcaggattggtgctggatgttgagaggcttgtcttcaaggatctggttaatgaaatcgtgcatgcagagacaagccgtctgcaagcaaagtcaggaaggcgacgaacgctttttgctgaccagtagctaagtctgttgaagaagacaaaatatatacacaagtggtttctctaactctttaactgtgttatgtttcactctggtcctttttttcgtctttgctgattcttatggtcgttcttgggtcttccgtattctacagcagaattataatcatatggtgtgttatgtaattactgaagttcttgagatggctacctaaagaaaaaactgtaaagcgatatagaaagagaattcataaaagaagaaagacaactaatggaaaattctctgtatctattgtttc

SEQ ID NO: 26 - protein, 1025 aa, Brassica rapa
MAAKLLHSLADDSADLQKQIGCMNGIFQIFDRHHVLTGRRKSLTLGNGNAININYERDSVDTIYQQKETFQDSNIGGNVKEKRRVSTESSRVSFSSSCSSSPSSSEFNRGVQPDASAYDRANFQESPTSDPEMTEGNGFSHLGLDLRDVVRDSMYREARGLLSKTPMTREEVVRQSRREDSPRPYGLKQSTPMDLNESFRVLARLRETSQHYNELGMKDAPRYSVDSHDTLKSRQKLKELPRLSLDSRERATRNSSVDPKSSKLSESFSESCSSSSKKRPPSVVAKLMGLETLPGSPLGRDIHQFGLNKTNISDQNDDPFSRSLREKNLNRAIRFSPSSPRSLGKDPASPRWRNSDFVMKPLSNTRFPVEPAPWKHADRNRVLQKQASMPVKAKPYEAPNFPPTVYSEMERRLNDLEFKHSGKDLRALKQILESMQSKGFLDTEKQQQSTNFAVQRDYERENSATSNHAMSSRTRVQSSSSNQVYQSPIVIMKPAKLVEKAGIPASSLIPIHSLTGIKKIRREKPDDKGTSASNSKRVTKDCSPGNRRAESCTSSFDKKSDSRNVRSSSKKPQQVSKESASKSSGSVSPRLQQKKLEYDKRSRPPTPPDSSKSRKPSNQQLVESTSPGGRRRPKGQKSLQQVDDQLSQASNESRTSSHGICTQSETEASACVEKSTEADGGKSPSVIEAAKAVVSNLMQNKSSPRFSEDGLSANLSLVALEHPSPISVLDASTYRETEPSPVKTQGNVAHDFGDENCEDQWNPAYSFSETTSSFSPEINRKKLQNVEHLVQKLRRLNSSHDEASQDYIASLCENADPTTDHRYISEILLASGLLLRDLGSGLTTFQLHPSGHPINPELFFVLEQTKGSSTTHLLHKEESKVLKNEKLNRKLVFDLVNEILVEKLASVEATTNPLMKSYAKVTKKAVSAQQLLKELCSAIETQQKQATKRSENFLLEEEDDFLKSILAEDVTIRSGNWADFSGEMSGLVLDVERLVFKDLVNEIVHAETSRLQAKSGRRRTLFADQ

SEQ ID NO: 27 - DNA, 3084 bp, Camelina sativa
atggctgcgaagcttctgcattcattggcagatgatagtgctgcagatctgcagaagcaaattggttgtatgaatgggatttttcaaatctttgatcgtcaccatgttctcactggccggcgaaaaagccttactttaggtagtgtaaatgctaatagcatcaacgacgagaaagaatctgttgatacaatttatcagcaaaaagaaacttttcaggactcgaacactggtgggaatgtgaaagagaagcaaagggtttcaacagaatcatcgagggtttctttctcatcttcatgttcgtcctccccatcttcttctgagtttaacagaggagttctacctgaagcttcttctgcctatgaccgagccaattttccagaatctccaacaagtgatcctgagatgaccgaaggtaatgggttttcacatctgggacttgacctcagagatgttgtgagagactcaatgtacagagaagccagagggcttttgattaagactccaataacaagagaagaagtagttagacacagtagacgagaggattccccaaggccttatggtttgaagcaatcaactcccgcggatctcaatgagtccttcagagttctagcaaaacttagagaaacatctcaacattataacgagactggtaagaaagatgcacctcgctactcagttgattctcatgatacgctgaaatccagacagaagctaaaagagttgcctaggctttcgctggatagtagagaacgagtgatgcaaaactctggtgttgatcctagatcaagtaagctttctgaaagtttcagtgaaagctgttcaagcagcagcaagaaacggcctcccagtgttgttgcaaagctcatgggattggagacattgccaggatctccattgggtagagacattcatcagtttggtttgaacaaaaccagcacctctgatcaaaacgacgatccattttcaagatcattgagggagaaaaatctgaaccgtgccatccgtttttctcctagctcaccaagaagcttggggaaggacccggcttctccaagatggagaaactctgactttgttatgaaacctctatcaaatacaagattccccattgaaccagctccatggaaacaagctgatagaaaccgagttttgcaaaagcaagctagcatgcctgtgaaagcaaagccgtatgaggcacctaatttttctcctacagtgttcagtgaaatggagcgtagattgaatgagcttgagttcaaacattcgggaaaagatctgcgagcccttaaacaaatattagagtctatgcagtcaaagggtttcctggatactgagaaacaactacaatcctcaaacgttgcagctcaaaaggattatgaaagagaaaattctgcaacttccaaccatgcaatgccatccataacgagagcgcagccttcttcatcttcagctaaccaggtatatcaatccccgattgtgattatgaaacctgccaagcttgttgaaaaggctggtattcctgcgtcatcccttattcccattcacagcctatctggcctcaataagatccgtagagaaaaacctggtgataaagaaacttcagcaagtagtaaacgggtgacaaaagatcgtagtcctgtaaaccgaagagctgagtcctgtaccagctctttcgataagaaatctgacagcagaagtgtgcggtctacttcaaaaaggcctcagcaggttcccaaagaaagtacttcaaagagttcaggatctgtaagtccaagattacagcagaagaagcttgagtatgataaacgttcacggccaccaacacctcctgattctagcaaatcgaggaaaccgtcaaaccaacaacttgtggaatctacttctcctggtggcaaacgtagacccaaggctcggaagagtttgcagcaaaatgatgaccaacttagtcaagcaagcaatgaatctaggacgtcaagtaatgacgtttgtactccatccgaaacagaagcctctgcttgtgtagaaaaagctactgaagccgatggtggtaaaagtccatctgtaatcgaggcagccaaagctgtagtctctaacttaatgcagaataaatccagtccaaggtttagtgaagatggattctcagcgaacctttcagtagttgctttggaacatccaagtcctatttctgttctcgacgcttcaacgtacagagagattgaaccatcacccgtgaagacacaaggtaatgtagctgatgactttggtgatgaacattgcgaggaccagtggaatccagcttacagtttctcagaaaccacatcaagcttttcgccagagataaaccgtaagaagcttcagaatgttgagcacttggttcaaaagctcagacgactgaactctaaccatgatgaagccagccaagattatatcgcatcgctctgtgagaacccggatcctaccactgatcatagatacatctcggagattctgttagcctcgggccttctcctcagagaccttggctcaggattgacaacgtttcagctacacccttctggccacccaatcaatcctgagctgttctttgttcttgagcagacaaagggaagcagcactatgcatttacacaaagaggaaagtaaggttctgaaaaatgagaagctcaaccgcaaacttgtgtttgacaccgttaatgagattctggtagagaaactagcttcagttgaagccacgacgaatccattgatgaagtcatctgctaagatgactaagaaatccgtgagtgctcaacaattactgaaagaactgtgttcagcggtagaaacaatgcaaaagcaagccacaaagaggtcggaaagcttcttattggaggaagaagacgacttcttgaaaaatatacttgctgaagatgtgacgattcgatctgggaactgggcagacttcagtggagaaatctcagggttggtgctggatgtggagaggcttctcttcaaggatctggttagtgaagttgtacatgcagagactagccgtgtgcaagcaaagtcaggaaggcgaagaacactttttgcagaccaatag

SEQ ID NO: 28 - DNA, 4860 bp, Camelina sativa
tttttttttttttttttttttttttttttttatctttatcgtttagtttattgaagattggatctaaattaccaaaagggttttttatcttttctccttttcgttttgtcttcagtgaatctgggaatcttaggtttgtataaaggtgtaaactttatttccttttagatccgtaggttgcttgctagtgtctagttgtggtgggacttagattagattttattttgggggtgaatttagcgggttttaagctttaattaagctgaagaaattacaatggggaggaggggttgtgtgatttgaaatcttaaacgggtttcaagttttttttctttttctttttctacaaagataaaaggctatgattttggagttatatgaatatggaaggtgcgtcattctcgttatagagttttaatggtgggtggttactgtttgatgatggagatagagagaaaagcaaaaaaataagaaagctttttaaagtgatctcttccttattattgcaaacacatcattgaggccaaaaagtttgggttttttggaaatcaatcatcacagaagaaagaaagctttcaaaaccaaaaagtaagaaaagaaaagagaagtctttttgaatctttctgtataaagtttccggcgccggaggattggctggttttgtgattgtatagagaaatggctgcgaagcttctgcattcattggcagatgatagtgctgcagatctgcagaagcaaattggttgtatgaatgggatttttcaaatctttgatcgtcaccatgttctcactggccggcgaaaaagccttactttaggtaaattaaattatttatatttatattttttggtgataatttaaacactctcttctgatctcgtgtctcgtagtcgttgactcgtatgtggttacaacatgtatgtaattcttaattcatgtcttttacttttctttttcttctctattttgttttggctctgcatctgccaatgtagtgtttcaatcttttcattaaccaagtcttagttacagtctcagagatctaagttttggttgttgtctttttctttctttctcagttgtgttgatctgccggatctttagtttagatttagtttcccttctggccagttttttcttggtagattttgacttttattaaccttaggctcatgaagtttccaaccaaatgtgataaattcaagtttgactaactggtacgtataggtttttattaatggtttctctgaatgcattatcggggtgttccttgtttgagagtttgggtatgatgctcatgcttggtttatgtgcttgttgcaggtagtgtaaatgctaatagcatcaacgacgagaaagaatctgttgatacaatttatcagcaaaaagaaactgtaagttgcttctcttgtcaaacatatatatacacgaggttttctataaataagatcttaagggtttttgcaattcagtttcaggactcgaacactggtgggaatgtgaaagagaagcaaagggtttcaacagaatcatcgagggtttctttctcatcttcatgttcgtcctccccatcttcttctgagtttaacagaggagttctacctgaagcttcttctgcctatgaccgagccaattttccagaatctccaacaagtgatcctgagatgaccgaaggtaatgggttttcacatctgggacttgacctcagagatgttgtgagagactcaatgtacagagaagccagagggcttttgattaagactccaataacaagagaagaagtagttagacacagtagacgagaggattccccaaggccttatggtttgaagcaatcaactcccgcggatctcaatgagtccttcagagttctagcaaaacttagagaaacatctcaacattataacgagactggtaagaaagatgcacctcgctactcagttgattctcatgatacgctgaaatccagacagaagctaaaagagttgcctaggctttcgctggatagtagagaacgagtgatgcaaaactctggtgttgatcctagatcaagtaagctttctgaaagtttcagtgaaagctgttcaagcagcagcaagaaacggcctcccagtgttgttgcaaagctcatgggattggagacattgccaggatctccattgggtagagacattcatcagtttggtttgaacaaaaccagcacctctgatcaaaacgacgatccattttcaagatcattgagggagaaaaatctgaaccgtgccatccgtttttctcctagctcaccaagaagcttggggaaggacccggcttctccaagatggagaaactctgactttgttatgaaacctctatcaaatacaagattccccattgaaccagctccatggaaacaagctgatagaaaccgagttttgcaaaagcaagctagcatgcctgtgaaagcaaagccgtatgaggcacctaatttttctcctacagtgttcagtgaaatggagcgtagattgaatgagcttgagttcaaacattcgggaaaagatctgcgagcccttaaacaaatattagagtctatgcagtcaaagggtttcctggatactgagaaacaactacaatcctcaaacgttgcagctcaaaaggattatgaaagagaaaattctgcaacttccaaccatgcaatgccatccataacgagagcgcagccttcttcatcttcagctaaccaggtatatcaatccccgattgtgattatgaaacctgccaagcttgttgaaaaggctggtattcctgcgtcatcccttattcccattcacagcctatctggcctcaataagatccgtagagaaaaacctggtgataaagaaacttcagcaagtagtaaacgggtgacaaaagatcgtagtcctgtaaaccgaagagctgagtcctgtaccagctctttcgataagaaatctgacagcagaagtgtgcggtctacttcaaaaaggcctcagcaggttcccaaagaaagtacttcaaagagttcaggatctgtaagtccaagattacagcagaagaagcttgagtatgataaacgttcacggccaccaacacctcctgattctagcaaatcgaggaaaccgtcaaaccaacaacttgtggaatctacttctcctggtggcaaacgtagacccaaggctcggaagagtttgcagcaaaatgatgaccaacttagtcaagcaagcaatgaatctaggacgtcaagtaatgacgtttgtactccatccgaaacagaagcctctgcttgtgtagaaaaagctactgaagccgatggtggtaaaagtccatctgtaatcgaggcagccaaagctgtagtctctaacttaatgcagaatgtgagttctgactctcatttgtatatctaagtgctaggtgtcaaaagtttttcacttagttctcacaagttatgttttgtgtttgcagaaatccagtccaaggtttagtgaagatggattctcagcgaacctttcagtagttgctttggaacatccaagtcctatttctgttctcgacgcttcaacgtacagagagattgaaccatcacccgtgaagacacaaggtaacaaaaggattctatctctagtgtcctcgtggtcatcaacctctgagaatattgacatggataagaaacttgcaaaaatcaatgccactttaagattctatgaccagggttaactcttacattttgtctgtagcttgcttagtttgagaaagtttctcttttacaatttttttctcaatacaaggattagctgttcagttccttccatttttgacccagaactgatcatgtgataggtaatgtagctgatgactttggtgatgaacattgcgaggaccagtggaatccagcttacagtttctcagaaaccacatcaagcttttcgccagagataaaccgtaagaagcttcagaatgttgagcacttggttcaaaagctcagacgactgaactctaaccatgatgaagccagccaagattatatcgcatcgctctgtgagaacccggatcctaccactgatcatagatacatctcggagattctgttagcctcgggccttctcctcagagaccttggctcaggattgacaacgtttcagctacacccttctggccacccaatcaatcctgagctgttctttgttcttgagcagacaaagggaagcagcactatgcatttacacaaagaggaaagtaaggttctgaaaaatgagaagctcaaccgcaaacttgtgtttgacaccgttaatgagattctggtagagaaactagcttcagttgaagccacgacgaatccattgatgaagtcatctgctaagatgactaagaaatccgtgagtgctcaacaattactgaaagaactgtgttcagcggtagaaacaatgcaaaagcaagccacaaagaggtcggaaagcttcttattggaggaagaagacgacttcttgaaaaatatacttgctgaagatgtgacgattcgatctgggaactgggcagacttcagtggagaaatctcagggttggtgctggatgtggagaggcttctcttcaaggatctggttagtgaagttgtacatgcagagactagccgtgtgcaagcaaagtcaggaaggcgaagaacactttttgcagaccaatagcaaagtctgttgaagaagattttataaacaaaagtggtttctcttctttctctaactctttaactgtgttctacgtttcactctggtttttttgtcttgctgattcatttgcttgtatttgggtctttatattctacagcaggataaaaatcatatggtgtgttatgtaattactgaagttcttctt

SEQ ID NO: 29 - protein, 1027 aa, Camelina sativa
MAAKLLHSLADDSAADLQKQIGCMNGIFQIFDRHHVLTGRRKSLTLGSVNANSINDEKESVDTIYQQKETFQDSNTGGNVKEKQRVSTESSRVSFSSSCSSSPSSSEFNRGVLPEASSAYDRANFPESPTSDPEMTEGNGFSHLGLDLRDVVRDSMYREARGLLIKTPITREEVVRHSRREDSPRPYGLKQSTPADLNESFRVLAKLRETSQHYNETGKKDAPRYSVDSHDTLKSRQKLKELPRLSLDSRERVMQNSGVDPRSSKLSESFSESCSSSSKKRPPSVVAKLMGLETLPGSPLGRDIHQFGLNKTSTSDQNDDPFSRSLREKNLNRAIRFSPSSPRSLGKDPASPRWRNSDFVMKPLSNTRFPIEPAPWKQADRNRVLQKQASMPVKAKPYEAPNFSPTVFSEMERRLNELEFKHSGKDLRALKQILESMQSKGFLDTEKQLQSSNVAAQKDYERENSATSNHAMPSITRAQPSSSSANQVYQSPIVIMKPAKLVEKAGIPASSLIPIHSLSGLNKIRREKPGDKETSASSKRVTKDRSPVNRRAESCTSSFDKKSDSRSVRSTSKRPQQVPKESTSKSSGSVSPRLQQKKLEYDKRSRPPTPPDSSKSRKPSNQQLVESTSPGGKRRPKARKSLQQNDDQLSQASNESRTSSNDVCTPSETEASACVEKATEADGGKSPSVIEAAKAVVSNLMQNKSSPRFSEDGFSANLSVVALEHPSPISVLDASTYREIEPSPVKTQGNVADDFGDEHCEDQWNPAYSFSETTSSFSPEINRKKLQNVEHLVQKLRRLNSNHDEASQDYIASLCENPDPTTDHRYISEILLASGLLLRDLGSGLTTFQLHPSGHPINPELFFVLEQTKGSSTMHLHKEESKVLKNEKLNRKLVFDTVNEILVEKLASVEATTNPLMKSSAKMTKKSVSAQQLLKELCSAVETMQKQATKRSESFLLEEEDDFLKNILAEDVTIRSGNWADFSGEISGLVLDVERLLFKDLVSEVVHAETSRVQAKSGRRRTLFADQ

SEQ ID NO: 30 - DNA, 2826 bp, Brassica napus
atggctgcaaagcttctgcattcgttggcagatgatagtgcagatctgcagaagcaaattggttgtatgaatggtatttttcagatctttgaccgtcaccatgttctcaccggccggcgaaagagtcttactttaggtagtggaaatgcaaatagcatcaacattgagagagactctgttgatacattttatcaagcaaaagacacttttcaggacacaaacattggtgggaatgtgaaagagaagcaaagggtttcaacagaatcatcaagggtttctttctcatcttcgtgttcgtcttccccatcatctcctgatttgaatagagttctacctgaagcttctgcttatgaccaagcccattttcctgaatctcctacaagtgactctgagatggccgaagggaatgggttttcacagctaggatttgacctcagggatgttgtgagagactctatgtacagagacgcaagagggctttcgctcaagactcctatgactagagaggaagtagtaagacgcagcagaagagaggactctccaaggccttatggtttgaagcaatccacacctgctgatctcagtgagtccttcaggtttctagccaagcttagagaatcaccacatcattataatgaggctggagcaaagggtgcaccagcacgttactctgttgattctcatgatacgttgaaatcaagacagaagttgaaagagctgcctaggctttcgctggatagcagagaaagagtggtgcaaaactctgttgttgatcttaaaccagttaagcttcctgaaagttcttcaagcagcaacaagaaacggcctccaagtgttgttgcaaagctcatgggtttggagacattgccaggttctccaaaaaacctgaaccgtacaataaggttttctcctagctcaccaagaagcttggggaaggacccttcttctcctagatggagaaactctgattttgttatgaagcctctatcaagttcaaggtttcccattgagccagctccgtggaagcaagctgatagaaacagagttcttcagaagcaacctgtgaaggcagcagcaccgcctgaagtggctaagtttcctcctactgtgtacagtgaaatggagaggagactgaacgatcttgagttcaaagattcaggaaaagatctgcgagctcttaaacaaatattagaggctatgcagtcaaaggttttgctggacactgagaaacaaccacaaccctcaaacatggcagctcaaagagattatgaaacttctaaccaagagatgacatcaagaactagagtgtatcaatctccgattgtgataatgaaacctgccaaacttgttgaaaaggctggtatccctgcgtcatctcttattccaattcacagtctatctggtgggcttaataagatccgtagagagaagcctgatgagaaaggagcttcaacaagtagtaaacggatgacaaaagacagtagtactggaaagggaagagctgaatcatcaaccagctctagtggtacttcaaagagttcaggttctgtaagtccaaggttgcagcagaagaagcttgagcatgacaaacgctcacggccaccgactcctccatctgattctactaaatcaaggaaaccgttgaaccgacaaatggcggagtctacttctcctggtggcagacgtagacccagggctcagaagagtttgcagcaaaatgatgaccaagttagtcaagggagcaatgagtcgaggacgtcgagtcatgaaatgtgtactcattctgaagcagaagcagcatctgtaattgaggcagccaaagctgtggtctctaacttaatgcagaataaatccagtccaaggtttagtgaagatggatcgtcagcaaacctttcactagttgctttggagcatccaagtcctatttctgttcttgacacctcaatttacagagagatggaaccatctcctgtgaagacacaaggttatgttgttgctcatgactctggtgatgatgaacattgcgaggatcagtggaatccagcgtacagtttctctgcgacaacatcaaccttttcgccagagataaaccggaagaagcttcaaaacgttgagcacttggttcaaaagctaagacgtctgaactctacccatgatgaagccaaccaagactacattgcttccctctgcgagaccccagatcccaacaccgatcacagatacatctccgagattctactagcctcaggtcttctgctccgagatctcggctcagggttaacaacgtttcaactacacccttcaggacacccgatcaacccagagctgttctatgttcttgagcagacaaagggaagcagcaacacgcatctgctgctacacaaagaagaaagcaaggctctgaacaaggagaagctcaaccgcaaacttgtgtttgacacggttaatgaacttcttgtggagaaactagcatcggttgaagccacaacgaatccgttgatgaagtcatctgctaagaaagtaatgagtgcgcaacagctactgaaagagctgtgctcagatatagaaacactgcaaagacaagccacaaagagatctgaaaacttcctgttggaggaagaagacgacttcctgaagagtgtacttgcggaagatgtgatgattcggtctgggaactgggtgaacttcagtggagagacctcagggttggtgctggatgtggagaggcttgttttcaaggatctggtgaatgagatcgtgcatgcagaaactagccgtttgcaagcgaagtcgggaagacgaagaacgcttttcgcggaacagtaa

SEQ ID NO: 31 - DNA, 4636 bp, Brassica napus
ttttttccaaataaccatctcaagaacttcagttattacataacacaccatatgataattatcctgctgtataatactgaagaaccaaaaacaagcatgttgaatcagcagggcaaaagaaaagaccatagagtatatttatataattagtgtttcttcaacagccttagcttactgttccgcgaaaagcgttcttcgtcttcccgacttcgcttgcaaacggctagtttctgcatgcacgatctcattcaccagatccttgaaaacaagcctctccacatccagcaccaaccctgaggtctctccactgaagttcacccagttcccagaccgaatcatcacatcttccgcaagtacactcttcaggaagtcgtcttcttcctccaacaggaagttttcagatctctttgtggcttgtctttgcagtgtttctatatctgagcacagctctttcagtagctgttgcgcactcattactttcttagcagatgacttcatcaacggattcgttgtggcttcaaccgatgctagtttctccacaagaagttcattaaccgtgtcaaacacaagtttgcggttgagcttctccttgttcagagccttgctttcttctttgtgtagcagcagatgcgtgttgctgcttccctttgtctgctcaagaacatagaacagctctgggttgatcgggtgtcctgaagggtgtagttgaaacgttgttaaccctgagccgagatctcggagcagaagacctgaggctagtagaatctcggagatgtatctgtgatcggtgttgggatctggggtctcgcagagggaagcaatgtagtcttggttggcttcatcatgggtagagttcagacgtcttagcttttgaaccaagtgctcaacgttttgaagcttcttccggtttatctctggcgaaaaggttgatgttgtcgcagagaaactgtacgctggattccactgatcctcgcaatgttcatcatcaccagagtcatgagcaacaacataacctaatgacaggatcagttctgagtcagtgactttgatgcttttcagtgttgatagacaataagaacagtggagatagaatatgattactaccttgtgtcttcacaggagatggttccatctctctgtaaattgaggtgtcaagaacagaaataggacttggatgctccaaagcaactagtgaaaggtttgctgacgatccatcttcactaaaccttggactggatttctgaaaataccaaaacaaacaaaaacttgtgagaactaataactcaaaatcatttcacacttgagacatattaaggagggcacagaactcacattctgcattaagttagagaccacagctttggctgcctcaattacagatgctgcttctgcttcagaatgagtacacatttcatgactcgacgtcctcgactcattgctcccttgactaacttggtcatcattttgctgcaaactcttctgagccctgggtctacgtctgccaccaggagaagtagactccgccatttgtcggttcaacggtttccttgatttagtagaatcagatggaggagtcggtggccgtgagcgtttgtcatgctcaagcttcttctgctgcaaccttggacttacagaacctgaactctttgaagtaccactctctttggaaaccttatgaggtttctttgaagaagacggcacgtttctgctgttaggtttcttatcaacagagctggttgatgattcagctcttccctttccagtactactgtcttttgtcatccgtttactacttgttgaagctcctttctcatcaggcttctctctacggatcttattaagcccaccagatagactgtgaattggaataagagatgacgcagggataccagccttttcaacaagtttggcaggtttcattatcacaatcggagattgatacacctggttatatgaagaagagggaactctagttcttgatgtcatctcttggttagaagtttcataatctctttgagctgccatgtttgagggttgtggttgtttctcagtgtccagcaaaacctttgactgcatagcctctaatatttgtttaagagctcgcagatcttttcctgaatctttgaactcaagatcgttcagtctcctctccatttcactgtacacagtaggaggaaacttagccacttcaggcggtgctgctgccttcacaggttgcttctgaagaactctgtttctatcagcttgcttccacggagctggctcaatgggaaaccttgaacttgatagaggcttcataacaaaatcagagtttctccatctaggagaagaagggtccttccccaagcttcttggtgagctaggagaaaaccttattgtacggttcaggtttttctccctcaatgatcttgagaatggatcgttgttatcgttaaaagtgttcaaaccaagcttatggatgtctctacccactggagaacctggcaatgtctccaaacccatgagctttgcaacaacacttggaggccgtttcttgttgctgcttgaagaactttcaggaagcttaactggtttaagatcaacaacagagttttgcaccactctttctctgctatccagcgaaagcctaggcagctctttcaacttctgtcttgatttcaacgtatcatgagaatcaacagagtaacgtgctggtgcaccctttgctccagcctcattataatgatgtggtgattctctaagcttggctagaaacctgaaggactcactgagatcagcaggtgtggattgcttcaaaccataaggccttggagagtcctctcttctgctgcgtcttactacttcctctctagtcataggagtcttgagcgaaagccctcttgcgtctctgtacatagagtctctcacaacatccctgaggtcaaatcctagctgtgaaaacccattcccttcggccatctcagagtcacttgtaggagattcaggaaaatgggcttggtcataagcagaagcttcaggtagaactctattcaaatcaggagatgatggggaagacgaacacgaagatgagaaagaaacccttgatgattctgttgaaaccctttgcttctctttcacattcccaccaatgtttgtgtcctgaaactgaaatgcaaaaagccttaggattgatcttacagacaacattagatcattgacccttaagaataaacttacagtgtcttttgcttgataaaatgtatcaacagagtctctctcaatgttgatgctatttgcatttccactacctgcaataaacaagcttgaggatcatatcacaagtcttaaacaaggatgaggcattgcaagtcaaacttttatttatcacatttggttggaaacttcatgagactaatgttaatagaagtcaaaatctaccaagaaaaataaatctaaccaaaagatttggcagatcaacaccattgagaaaggaaacaaaaaccagaaaattagatctctgacaatgtaacaagacctggtttaactaaagaaaatagagaagaaaggaaagcaaaagatatgatttaacaattacacaagtgaccatctatctctacaccaagtcaacgacaacaatacacaaaccatagagaccaaaacaaatgtgttaaaaaaaatatcaaatatatttacctaaagtaagactctttcgccggccggtgagaacatggtgacggtcaaagatctgaaaaataccattcatacaaccaatttgcttctgcagatctgcactatcatctgccaacgaatgcagaagctttgcagccatttcaaaaaagttctcttctttttttggctttagaaactttcttctgtgtgtgttgttgtggtgctcttccctttttgatttccaaagaccctaacttttagcctcactgatgacttttaaagctttctttttctttctccatcattcagcagtgaccaccattaaagccatgacgagaatgatgcaaccttccatttaaaactccaaatttttagccttttctctttgtataaaacttgaaagccgttcaagatctcaaaaaaaaaattaaaaattaaaaagaaaaaaactaatctttttaaacagagttttgagtcccacacctacagatctaaaaggaaagcaaaagtttccaccttttttacagagctagattctcaaattccactcaagacaaaaggaaaaggaagagagatgagaaacccttttggtaattagatctaatcttacaagaatctaacttagaagatgaacagacacattagagaacatgtgtgaccctttgtctgaagaaaaaaacagtgttaaacagagagtgtaccttacaaattacagaaccaatgaagagaggaagagttgcagatgaagagaaacagccaaatgaaggaggaagaagaggaggttaaagaaaggaacaaaggaatctcactacagatccaagaagagactaaatgttcctctctgtttgtacttactggtaactgctcagagaacaaaccggaaatacagccacataatgcttattggaaaatgggagtattcttctctttttcttttctttttctttttctaaataaaatgtagagaaaaatgttagtaaaacaaaac

SEQ ID NO: 32 - protein, 941 aa, Brassica napus
MAAKLLHSLADDSADLQKQIGCMNGIFQIFDRHHVLTGRRKSLTLGSGNANSINIERDSVDTFYQAKDTFQDTNIGGNVKEKQRVSTESSRVSFSSSCSSSPSSPDLNRVLPEASAYDQAHFPESPTSDSEMAEGNGFSQLGFDLRDVVRDSMYRDARGLSLKTPMTREEVVRRSRREDSPRPYGLKQSTPADLSESFRFLAKLRESPHHYNEAGAKGAPARYSVDSHDTLKSRQKLKELPRLSLDSRERVVQNSVVDLKPVKLPESSSSSNKKRPPSVVAKLMGLETLPGSPKNLNRTIRFSPSSPRSLGKDPSSPRWRNSDFVMKPLSSSRFPIEPAPWKQADRNRVLQKQPVKAAAPPEVAKFPPTVYSEMERRLNDLEFKDSGKDLRALKQILEAMQSKVLLDTEKQPQPSNMAAQRDYETSNQEMTSRTRVYQSPIVIMKPAKLVEKAGIPASSLIPIHSLSGGLNKIRREKPDEKGASTSSKRMTKDSSTGKGRAESSTSSSGTSKSSGSVSPRLQQKKLEHDKRSRPPTPPSDSTKSRKPLNRQMAESTSPGGRRRPRAQKSLQQNDDQVSQGSNESRTSSHEMCTHSEAEAASVIEAAKAVVSNLMQNKSSPRFSEDGSSANLSLVALEHPSPISVLDTSIYREMEPSPVKTQGYVVAHDSGDDEHCEDQWNPAYSFSATTSTFSPEINRKKLQNVEHLVQKLRRLNSTHDEANQDYIASLCETPDPNTDHRYISEILLASGLLLRDLGSGLTTFQLHPSGHPINPELFYVLEQTKGSSNTHLLLHKEESKALNKEKLNRKLVFDTVNELLVEKLASVEATTNPLMKSSAKKVMSAQQLLKELCSDIETLQRQATKRSENFLLEEEDDFLKSVLAEDVMIRSGNWVNFSGETSGLVLDVERLVFKDLVNEIVHAETSRLQAKSGRRRTLFAEQ

SEQ ID NO: 33 - DNA, 3279 bp, Solanum lycopersicum
atggctgctaagcttttacattcattgactgaagataatcaagatctgcaaaagcaaattggatgtatgacagggattttgcacatatttgatcgtcaaagtatgcttgctagtaggcgcctaatcggcaacagccccagaaggctcacttctggcagctctcacattggcagtggtacttctgagaaagagtacactagcacatatccaaaatcaccagctatggaaagccacacaaacaagactgtgcaagataaacaaagattgtctacagaatcgtcgagaccatcattctcatcttcttcacgttcgtcttccttttcttctcttgattgtaataaaacaagtcaacaagagcccttagcttttgatcgactaagttttgctgaaactccttcaagagaaccagctgcaggccaaccaaatgcatcaccacaatttggtaggcaatctcttgacattcgggatgtggttaaggattctatgaatagagaagctcagaggttctcagctggacctgcagtgaaagaagaggtggcagaatcgatgtcaaagcccggggattccccaaggccagttcagactttgaaaaactttgacggggcttatgattcgggcccaaatgggaagcagaattcgtctgttgatcttaaggaatctctcagagttcttgctaaacttcgggaagctccttggtactcaagtgaacatagggaacttacaagatcattatcatatcattcaaaggatacttctacattatcagtctcgaaagatgctcctcgtttctcatatgatgggagagaaacaaatcatgtaccctttgaacagcgagacatttccaaatccactcttaagcttaaagagctaccaagactttccttggacagtagagttagtccagtacgaagcttgaactcagaaccaaaatctaatttctcctcaaaatctatgcagaaggatagtggtaataccaatgcaaagtcaccaactctgcagcaaacatctgggactccggctcgtcctcctagtgttgtggcaaagctaatgggtcttgatacactacctggttccatgtcatcaactgacaacaagatggggttgagcacttcttcacaagttgaagcacctgtttcttttccaaggtcttcagaagtatctgatccgtgcaaacctatccgaacttctaatacctctaagaacctgtggaaagaacctacttctcctaagtggagaaaccctgatatggctatgaaacctatatccaggtttcccattgaaccagcaccctggaagcaacctgataggactcgagtgtatgagaaaccgatatccaggacaacaaaaactccagtaaagccagcccacccctttccttctgtttacagtgagatagaaaagagatggaaggatctagaattcacccattcaggcaaggatctaagagctcttaaacagatattggaagcaatgcaggcaaagggcctcctagagacagaaaaagaggagcaggattcaaattttactggtcagaaagagcatcaccagaagtttgcaagtcctgcacagagtgcaaaactggcgaaccagagaatgaggcagactgatcaagtgactgctccaacaaagagggggattaattcttcaaggaattttgaatccccaatagtgatcatgaagccagcaaaattagtggaaaaatctgacattccttcgtcttcgatgattccacttcatggtggtgactctgtcagtagaaagggtaattctgtgagcagggctgctaaagaacatcaacctagaactagtcatggaaacagtccagtgaatcccaatgaagcaagaagaacttcgaaacctccacagatttcaacaaggtcccaacagcttcctaaagagatcatctcaggctcaataaagagctcaggatccatcagtccaagattgcaacagaataaactggagctagagaaaaaatctcggccacccacacctccatctgattccaacagatcgaggagacagtcaaacaagcaacatacagaggctagttccccaggcggaagacgaaggccaagaatttcaaacatccagcaacatgatgaccatgtgagtgagatcagtagtgaatcaaggaatttgagttgccacgggaataaaatttctggtcaatccaatgggaatgtggtagcagaatcaaaagtggatttcgaagttactagtttcgagcgctctcttgagatgacaagcagcccgagttcatctattgatgcatccagttacctgagatgtgacttggtagagaagaaatcaattcgggtgctctctgaggatgaaatgttaactgaacctgctccagagtatccaagtccggtatcggttcttgataatgctgtatatatggatgaatcaccctctcctgtgaagcatactccaaaagtcatgaaagatgaaagctgcaacactgctgataaattttccagtccgccacagtgtgatcgatctaatactcttgcgattgatgccaccagttctggtctctcctcagaaatcaatagaaaaaagttgcaaaacattgagaatttagttgagaagctcaggagattgaactccagccatgatgaggctcgcacggattacattgcgtctctctgtgagaacacaaaccctgaccacagatacatttcagagatcttattggcttcaggactccttctcagggatctcggctcaagcctaactagtttccagttccatccatcaggtcacccaatcaaccctgagctgttcctagtcttggaacaaaccaaggcaagcactttactcaaggaggaactctgcaatgataagatgaggcagtcgaatccaaaggaaaagatccgtaggaaactcatctttgatgttgttaatgagagtcttgctggaaaactaatgctagtgggaccttcgtacgagccatggttgatgtcccagaagctagcaaagagcaccctgaatgctcaaaggcttctaagggacttgtgctcagagatagaacaacttcaagctaaaccatcaaaatgcaacatggaggatgaggaggatgagtggaaaaacatactgctggatgacgtggtgcatcgttcagagagttggacgattttcacaggtgagatatcgagtgtagtccttgacgtggagcggatgatctttaaagatttagttgatgagatagtaaggggtgatggttctggtttgagagcaaaaccaactaggcgtagacagctctttgcaaaatag

SEQ ID NO: 34 - DNA, 6159 bp, Solanum lycopersicum
tgtggaagcaaaatgaggtgaagacagcatcacatgaagatgcagacaaatttagacccacccccatacccatgtaattcaactcacatggaagagggaaggggtaaggcactgcaaaacatcttctctctctttacactccacatcaagatatgcatactaataatactaaaactagtactaattatgctgttagtatcaatcttgattatagtactttaatatttcttgccaactcctccctcactatcaactcattggcaagcacatgtacccctgttagtttttctctctctagtactacttcttgtttcaatctctggggctttttcttctttctccaagaaaacagcatttcaaacatttacctatggatctacagtgatagaccctttacagtttttgcactagtgcattcactttcttggcaactgagagctactttgtgattttcacaatttgatgttaccattgcttttttcctcaactttttaggcttctttaaagaaaaatcaagaacctgatttgttcttgtggggtgtgttagtttgttccacttttcattagtaagagatcgattaaaattttgtgcatttttctgaagtactggagaaacaaagttcattacctttgattttctgttgtaaaaatcaaatcttggtttttggggttgttgctaaatgatgaaaactgaatgattttgacatgtataaagtatgctgctggagatgattcaggcttgtaatccctagcattagtggtaatggtgcctaggagaggttttccaattcttctttgttgtgtgtggttaggaactgactccagctgtgattgtgaagatatattgacttttgactatctagagatatgagtgataatgcattgattggccaatgaaaaaaagtgagtaatagtttaaagagggatttgactttataggttgtgctgtgttgaagaggagaggaatacaagtagaaccatggctgctaagcttttacattcattgactgaagataatcaagatctgcaaaagcaaattggatgtatgacagggattttgcacatatttgatcgtcaaagtatgcttgctagtaggcgcctaatcggcaacagccccagaaggctcacttctggtaatatttcattgtgttgtgtctaattctattatatcatacatgttcattgtagaatctagaatgtgttttactttctcttatgtcaacaacaatattgaataatggtgtttgcttatttgttgaaaatgtaaaatcaatatttcatccatgttctcatgtaaaattttctaggattcttcaaacgaaattcgagatatcatacttatatataacaagggggtgcttcaattgttttttttttttactgtacaagttttgtaacatcatgtgaatgacttcttacaggcagctctcacattggcagtggtacttctgagaaagagtacactagcacatatccaaaatcaccagctatggtaagagttatttgtgctaacttgttatctctcctctctctctctctctttctctttcgactttgaaaaatatattcatttgagccagttggaatgtttatgaggtcgttagcatcaaacagttcatcttgaatgtgattgacaacgatgtagacactactgagttgtatgtttgcataggaagacttctgagtgatgtctgatgataacttggtttcattttttctctcttttaaaaatagcaattcagataattgatgtgttagatttgaatccactaatttcttttccatctcaccaagtctgttgaatgtttaacgactcttgtatcttttgacagctgaatttctttgatatcatatcctgaaagcttgatggcactgcttttcattgcaggaaagccacacaaacaagactgtgcaagataaacaaagattgtctacagaatcgtcgagaccatcattctcatcttcttcacgttcgtcttccttttcttctcttgattgtaataaaacaagtcaacaagagcccttagcttttgatcgactaagttttgctgaaactccttcaagagaaccagctgcaggccaaccaaatgcatcaccacaatttggtaggcaatctcttgacattcgggatgtggttaaggattctatgaatagagaagctcagaggttctcagctggacctgcagtgaaagaagaggtggcagaatcgatgtcaaagcccggggattccccaaggccagttcagactttgaaaaactttgacggggcttatgattcgggcccaaatgggaagcagaattcgtctgttgatcttaaggaatctctcagagttcttgctaaacttcgggaagctccttggtactcaagtgaacatagggaacttacaagatcattatcatatcattcaaaggatacttctacattatcagtctcgaaagatgctcctcgtttctcatatgatgggagagaaacaaatcatgtaccctttgaacagcgagacatttccaaatccactcttaagcttaaagagctaccaagactttccttggacagtagagttagtccagtacgaagcttgaactcagaaccaaaatctaatttctcctcaaaatctatgcagaaggatagtggtaataccaatgcaaagtcaccaactctgcagcaaacatctgggactccggctcgtcctcctagtgttgtggcaaagctaatgggtcttgatacactacctggttccatgtcatcaactgacaacaagatggggttgagcacttcttcacaagttgaagcacctgtttcttttccaaggtcttcagaagtatctgatccgtgcaaacctatccgaacttctaatacctctaagaacctgtggaaagaacctacttctcctaagtggagaaaccctgatatggctatgaaacctatatccaggtttcccattgaaccagcaccctggaagcaacctgataggactcgagtgtatgagaaaccgatatccaggacaacaaaaactccagtaaagccagcccacccctttccttctgtttacagtgagatagaaaagagatggaaggatctagaattcacccattcaggcaaggatctaagagctcttaaacagatattggaagcaatgcaggcaaagggcctcctagagacagaaaaagaggagcaggattcaaattttactggtcagaaagagcatcaccagaagtttgcaagtcctgcacagagtgcaaaactggcgaaccagagaatgaggcagactgatcaagtgactgctccaacaaagagggggattaattcttcaaggaattttgaatccccaatagtgatcatgaagccagcaaaattagtggaaaaatctgacattccttcgtcttcgatgattccacttcatggtggtgactctgtcagtagaaagggtaattctgtgagcagggctgctaaagaacatcaacctagaactagtcatggaaacagtccagtgaatcccaatgaagcaagaagaacttcgaaacctccacagatttcaacaaggtcccaacagcttcctaaagagatcatctcaggctcaataaagagctcaggatccatcagtccaagattgcaacagaataaactggagctagagaaaaaatctcggccacccacacctccatctgattccaacagatcgaggagacagtcaaacaagcaacatacagaggctagttccccaggcggaagacgaaggccaagaatttcaaacatccagcaacatgatgaccatgtgagtgagatcagtagtgaatcaaggaatttgagttgccacgggaataaaatttctggtcaatccaatgggaatgtggtagcagaatcaaaagtggatttcgaagttactagtttcgagcgctctcttgagatgacaagcagcccgagttcatctattgatgcatccagttacctgagatgtgacttggtagagaaggtaagaaatttccatttatttgtgcattttatagagtacttcaagcaggccattacatgcttgacactgtgacttccatttcagaaatcaattcgggtgctctctgaggatgaaatgttaactgaacctgctccagagtatccaagtccggtatcggttcttgataatgctgtatatatggatgaatcaccctctcctgtgaagcatactccaaaagtcatgaaaggtgctgctttcccttagtatttttgtgaagaaattataagcacgtctacataagcaaatatgagtggaaataataaatgaaactagctccttatgtggatgacatgttggggatatatttttagattttgttagctgaaactaaacatctgatcaggaatattcactttgcagttatccatccatggctatacaaataagtgaatgccagcagaattttaaataatacaaaaggaaaaataagtagaagagagactaaatctctgaataaaataggccaaggacagcgtaaggaaatttagaagttaagtcttttgggatgttgaagtgtgagcaggatttctccaataacagcgatagcaaatgcccaaacttggctccttaggagttcagactcaactagatcaagagactataatcactttgagagaacaaagtgaaacatgaatagtaacatgttaagctaagaaggcacttacatctatatgtacatctatatggtctttatatgcactagatttttcagttctggcttttatgctttcatgttctggtcacttatgtcagctagaatagcggaaaatggtagtaaaccttaaataattcttctcatcacaatgttggctccgaaaagaacttgcttgctcaagatcaggccatccacactggacaccagtttattcactgcacttgaacctcctttgtttttcaaaactaaacatattggagttctaattctagtaggaaaagtaagatcaatagcaaatattttaaagatgctcaaatgaatttatagtgaacattcagtaagaaatatcagatatgagtctctattatgttgtcagagtcccttgtctagagattaaaacagtcctgactattcaggtctcagaatatatacactgcttaagaagttggattctatttgtttgtctcatttctgttattctgtgacagatgaaagctgcaacactgctgataaattttccagtccgccacagtgtgatcgatctaatactcttgcgattgatgccaccagttctggtctctcctcagaaatcaatagaaaaaagttgcaaaacattgagaatttagttgagaagctcaggagattgaactccagccatgatgaggctcgcacggattacattgcgtctctctgtgagaacacaaaccctgaccacagatacatttcagagatcttattggcttcaggactccttctcagggatctcggctcaagcctaactagtttccagttccatccatcaggtcacccaatcaaccctgagctgttcctagtcttggaacaaaccaaggcaagcactttactcaaggaggaactctgcaatgataagatgaggcagtcgaatccaaaggaaaagatccgtaggaaactcatctttgatgttgttaatgagagtcttgctggaaaactaatgctagtgggaccttcgtacgagccatggttgatgtcccagaagctagcaaagagcaccctgaatgctcaaaggcttctaagggacttgtgctcagagatagaacaacttcaagctaaaccatcaaaatgcaacatggaggatgaggaggatgagtggaaaaacatactgctggatgacgtggtgcatcgttcagagagttggacgattttcacaggtgagatatcgagtgtagtccttgacgtggagcggatgatctttaaagatttagttgatgagatagtaaggggtgatggttctggtttgagagcaaaaccaactaggcgtagacagctctttgcaaaatagtatcattccattctcgacttctctttgttttccttttcagctaattatattgagtagtaaaataattcaggaatactcatttgtgtgatgtattgtaaaggaacaattgtcacttaattgtattaccaacatatctaatcaagatcaccagtgcagaaaaatgtactatatcctgta

SEQ ID NO: 35 - protein, 1092 aa, Solanum lycopersicum
MAAKLLHSLTEDNQDLQKQIGCMTGILHIFDRQSMLASRRLIGNSPRRLTSGSSHIGSGTSEKEYTSTYPKSPAMESHTNKTVQDKQRLSTESSRPSFSSSSRSSSFSSLDCNKTSQQEPLAFDRLSFAETPSREPAAGQPNASPQFGRQSLDIRDVVKDSMNREAQRFSAGPAVKEEVAESMSKPGDSPRPVQTLKNFDGAYDSGPNGKQNSSVDLKESLRVLAKLREAPWYSSEHRELTRSLSYHSKDTSTLSVSKDAPRFSYDGRETNHVPFEQRDISKSTLKLKELPRLSLDSRVSPVRSLNSEPKSNFSSKSMQKDSGNTNAKSPTLQQTSGTPARPPSVVAKLMGLDTLPGSMSSTDNKMGLSTSSQVEAPVSFPRSSEVSDPCKPIRTSNTSKNLWKEPTSPKWRNPDMAMKPISRFPIEPAPWKQPDRTRVYEKPISRTTKTPVKPAHPFPSVYSEIEKRWKDLEFTHSGKDLRALKQILEAMQAKGLLETEKEEQDSNFTGQKEHHQKFASPAQSAKLANQRMRQTDQVTAPTKRGINSSRNFESPIVIMKPAKLVEKSDIPSSSMIPLHGGDSVSRKGNSVSRAAKEHQPRTSHGNSPVNPNEARRTSKPPQISTRSQQLPKEIISGSIKSSGSISPRLQQNKLELEKKSRPPTPPSDSNRSRRQSNKQHTEASSPGGRRRPRISNIQQHDDHVSEISSESRNLSCHGNKISGQSNGNVVAESKVDFEVTSFERSLEMTSSPSSSIDASSYLRCDLVEKKSIRVLSEDEMLTEPAPEYPSPVSVLDNAVYMDESPSPVKHTPKVMKDESCNTADKFSSPPQCDRSNTLAIDATSSGLSSEINRKKLQNIENLVEKLRRLNSSHDEARTDYIASLCENTNPDHRYISEILLASGLLLRDLGSSLTSFQFHPSGHPINPELFLVLEQTKASTLLKEELCNDKMRQSNPKEKIRRKLIFDVVNESLAGKLMLVGPSYEPWLMSQKLAKSTLNAQRLLRDLCSEIEQLQAKPSKCNMEDEEDEWKNILLDDVVHRSESWTIFTGEISSVVLDVERMIFKDLVDEIVRGDGSGLRAKPTRRRQLFAK

SEQ ID NO: 36 - DNA, 2718 bp, Solanum lycopersicum
atgtctgcaaaacttctatataacttgtcagatgagaatccaaatctgaataaacagtttggatgcatgaatgggatctttcaagtgttttaccggcaacattgtcccgcgacaccagtcaccgtctccggcggcgcagagaagtctttgcctccaggggaaagaagaggtagcgtcggtgaaaccaacatggaaagtgataaagaaacggagaggagtagtaccaaaaagaagaagtctgcagcaaaagagaagcatagagtctcttttgaatcatcttcaagaccttcattttcgtcttctccacgctcctctagcttctcgtctgcagaagtcagtaccacagcttctcaatttgaccagcctggtgagaatctgatcagagaacagcccaatggtggcttgatgatgccgtatgatctaaaggagcttgtcaaaggctctattaatagagaaattagaactagaggtgaagaagcatccttcactcagcagcagcagcccatttcagctcgaagtagcatgttgcttctcaaagaatcatcattgcgttcaccatgtcggagttctaatgagtggaatgaaggaagaggagcggctatgaagtttaaggaaagtcaccggctttcttatgatgagagggagatgagaaacaacggattcagggtgggttcaaagttgaaagagacaccgaggttgtcgttggatagtagatccaattcctttaggagtccgagagcagatgctgcgagatcgagttgtccagaggaacccgcaacaatgactcacaggagatcgagttctagtgttgttgccaaattgatgggtcttgaagtcattgcagacaattctgatactgaacagagaagagagaaccggttttgtgactctccaaggccaatgtcccgagtggaaccaacagctctacagagatctagaagcgtagattcgatcaagaggatacctgcttcagctgcttctaagtttccaatggaaccagctccatggaagcaaatgaaagcaggagactctgcactgacggtatatggtgaaattcagaagcggcttacgcagttggagttcaaaaagtcgggaaaagatctcagagctcttaagcaaatacttgaggctatggagaaaacgcagcagctgatagatgaaagcagggacgacggtactctgagtacaaccactcttatgcagagaactcacaagccagtttcagctgcaacaagtccagccaggaacttcaaatcttcatcgatcgttgttatgaaatctgcagctccagtttccacctctccgctgccacagaatgtcaccctaccaaatgtcaaggttggaaactctagacaaacccggaaagtcacctcagggaagcagaacgcaatggatttaaccccaaggccaggcctttacaagggccaactcgattccacgaagagcaatagcccaaaaacagtacggtcgaggcaagctttggctgcagatgctggttccatgaccaagtcaggtaggagccaacagcacagtgtcagcccaagaacacagccaaaaaagctcgggttcgagaaacagactcgacccacaactccaaaatcagagccaggcaaaaggcaactcggaaggcagcaaacagaggtagcctctccgagaagaaaacagatgataaaacctcacagtactcttcagcaacctgatgaccgattaagcgatgcaaggagcgacttgaggagtctaaggtctgacagcaacataagcttgggatcgaatgttgacatcgaggttacaagcagacataggctggagaggaactgtgacttcccagagcagcacacccccaaacaaaggagtccagactttggaatcaaacaagacagaccgtccctaaaacctctgaaagttaccgttgaacaaccgagccctgtttcagttcttgatgcagtcttcgacgaagaggattcaccgtcccctgtgaggaagatatcccttagttttaaagaggaggatgccttacgttctgaagaatctgagtggataaacaagcctaccagcttctgcagatccgtaccatttcctcagagtaaccggggaccaatgaagccaagttctgatcattttgaatgctcacctgaagaaggtgcagacttcaaaagcggcaaccacaagtacatcttagagatattgttggcctcagggattctaagagatcttgaatacagcatgataagctttcagctgcaccaaacgcgcctcccgatcaaccctggactgttctttatcctggaacagaacaaggccagtaatgtgactctaccggacaacaaacacagaggtagaggattcagacaacagcagacaaacccaacagagacaatcaggagaaaactcgtcttcgacaccgttaacgagattttagctcggaagttcactgcagaaggctgcatcaaaccacgtttaatcgcaaatccacttaaaaaattggagaaaatatcaaaagaggagcaacttctgcagactctgtgttcagagattgataggttacaacaaaacaactcaaactgtatcttggaggacgacgaggaagacatcatatgggaggacctgcaaagtcaaagcatgaacttgaaggagtttgaaggagagactccaggaattgtgttagatattgagagaatgattttcagagacttggttaatgaagtttgcttctgctaa

SEQ ID NO: 37 - DNA, 3768 bp, Solanum lycopersicum
cactttttggtattatctatgaacttaaatactgttatttattaattagacctgtatatatatgctggttacaacaaacaagtgggaagagaacagaacaggcaagagggctgaaaacccagagactaaaggttctcttcctctctaagataacttcatttacaaatctaagtgataactgataaccttaaaaaaattagcagaagcaaacttcattaaccaagtctctgaaaatcattctctcaatatctaacacaattcctggagtctctccttcaaactccttcaagttcatgctttgactttgcaggtcctcccatatgatgtcttcctcgtcgtcctccaagatacagtttgagttgttttgttgtaacctatcaatctctgaacacagagtctgcagaagttgctcctcttttgatattttctccaattttttaagtggatttgcgattaaacgtggtttgatgcagccttctgcagtgaacttccgagctaaaatctcgttaacggtgtcgaagacgagttttctcctgattgtctctgttgggtttgtctgctgttgtctgaatcctctacctctgtgtttgttgtccggtagagtcacattactggccttgttctgttccaggataaagaacagtccagggttgatcgggaggcgcgtttggtgcagctgaaagcttatcatgctgtattcaagatctcttagaatccctgaggccaacaatatctctaagatgtacttgtggttgccgcttttgaagtctgcaccttcttcaggtgagcattcaaaatgatcagaacttggcttcattggtccccggttactctgaggaaatggtacggatctgcagaagctggtaggcttgtttatccactcagattcttcagaacgtaaggcatcctcctctgtggcaagagaacaaaaacacggtgagaactttatactaaccaaaaccttgtgaatacatgtagttaataagcatcgtgaacacgtaattgttagtatatatgaatgagtcactaatcagtctgaatgttcttttctaagtgcctcacctttaaaactaagggatatcttcctcacaggggacggtgaatcctcttcgtcgaagactgcatcaagaactgaaacagggctcggttgttcaacggtaactttcagaggttttagggacggtctgtcttgtttgattccaaagtctggactctacattggtagacagaagagattcagtttattgagtactaatgaattaacttgagaagtgaagatacgtgagatagagatctatttagtaccctttgtttgggggtgtgctgctctgggaagtcacagttcctctccagcctatgtctgcttgtaacctcgatgtcaacattcgatcccaagcttatgttgctgtcagaccttagactcctcaagtcgctccttgcatcgcttaatcggtcatcaggttgctgaagagtactgtgaggttttatcatctgttttcttctcggagaggctacctctgtttgctgccttccgagttgccttttgcctggctctgattttggagttgtgggtcgagtctgtttctcgaacccgagcttttttggctgtgttcttgggctgacactgtgctgttggctcctacctgacttggtcatggaaccagcatctgcagccaaagcttgcctcgaccgtactgtttttgggctattgctcttcgtggaatcgagttggcccttgtaaaggcctggccttggggttaaatccattgcgttctgcttccctgaggtgactttccgggtttgtctagagtttccaaccttgacatttggtagggtgacattctgtggcagcggagaggtggaaactggagctgcagatttcataacaacgatcgatgaagatttgaagttcctggctggacttgttgcagctgaaactggcttgtgagttctctgcataagagtggttgtactcagagtaccgtcgtccctgctttcatctatcagctgctgcgttttctccatagcctcaagtatttgcttaagagctctgagatcttttcccgactttttgaactccaactgcgtaagccgcttctgaatttcaccatataccgtcagtgcagagtctcctgctttcatttgcttccatggagctggttccattggaaacttagaagcagctgaagcaggtatcctcttgatcgaatctacgcttctagatctctgtagagctgttggttccactcgggacattggccttggagagtcacaaaaccggttctctcttctctgttcagtatcagaattgtctgcaatgacttcaagacccatcaatttggcaacaacactagaactcgatctcctgtgagtcattgttgcgggttcctctggacaactcgatctcgcagcatctgctctcggactcctaaaggaattggatctactatccaacgacaacctcggtgtctctttcaactttgaacccaccctgaatccgttgtttctcatctccctctcatcataagaaagccggtgactttccttaaacttcatagccgctcctcttccttcattccactcattagaactccgacatggtgaacgcaatgatgattctttgagaagcaacatgctacttcgagctgaaatgggctgctgctgctgagtgaaggatgcttcttcacctctagttctaatttctctattaatagagcctttgacaagctcctttagatcatacggcatcatcaagccaccattgggctgttctctgatcagattctcaccaggctggtcaaattgagaagctgtggtactgacttctgcagacgagaagctagaggagcgtggagaagacgaaaatgaaggtcttgaagatgattcaaaagagactctatgcttctcttttgctgcagacttcttctttttggtactactcctctcctgcaatcccataaaagtctctgtttctttcagtttgtgtttcctgaattctcattctttagagacgagtaaataaactgagttcagattcttaccgtttctttatcactttccatgttggtttcaccgacgctacctcttctttcccctgcaaaagttaaccccttgttcttagctataagcctataaccatatttttggttctagtgaaactactctgtttctttgtggtcctaaacactcaactgagatttagaagagagagagagtttaagttacctggaggcaaagacttctctgcgccgccggagacggtgactggtgtcgcgggacaatgttgccggtaaaacacttgaaagatcccattcatgcatccaaactgtttattcagatttggattctcatctgacaagttatatagaagttttgcagacatatcttcttcctctacttaactcttatctcaaaaacaagataactaaaaaaactttcacaaactcaagtttctcttcatatatatactctgttttttggagttaccagtttcttcgtctttttactctgctcaggggttaaagatgtttttcttgtgtttcagaggaagaagaaaagaagaaatggacaagaagaagccaacattaacgacaaattatagcttcttgtgaagttacgagcagacaacagattaggttcctccgtgtttggcttggaggctaccttgaagaagaaagaagagaagggggaaaaaaaaaaagttttttttttgtttttggtctttgagagagagaggtttctatctttaaaggcaaagatacaactgtc

SEQ ID NO: 38 - protein, 616 aa, Solanum lycopersicum
MSAKYNSDNNNKGCMNGIVYRHCATVTVSGGAKSGRRGSVGTNMSDKTRSSTKKKKSAAKKHRVSSSSRSSSSRSSSSSAVSTTASDGNIRNGGMMYDKVKGSINRIRTRGASTISARSSMKSSRSCRSSNWNGRGAAMKKSHRSYDRMRNNGRVGSKKTRSDSRSNSRSRADAARSSCATMTHRRSSSSVVAKMGVIADNSDTRRNRCDSRMSRVTARSRSVDSIKRIASAASKMAWKMKAGDSATVYGIKRTKKSGKDRAKIAMKTIDSRDDGTSTTTMRTHKVSAATSARNKSSSIVVMKSAAVSTSNVTNVKVGNSRTRKVTSGKNAMDTRGYKGDSTKSNSKTVRSRAAADAGSMTKSGRSHSVSRTKKGKTRTTKSGKRGRTVASRRKMIKHSTDDRSDARSDRSRSDSNISGSNVDIVTSRHRRNCDHTKRSDGIKDRSKKVTVSVSVDAVDDSSVRKISSKDARSSWINKTSCRSVSNRGMKSSDHCSGADKSGNHKYIIASGIRDYSMISHTRINGINKASNVTDNKHRGRGRTNTTIRRKVDTVNIARKTAGCIKRIANKKKISKTCSIDRNNSNCIDDDIIWDSSMNKGTGIVDIRMIRDVNVCC

SEQ ID NO: 39 - DNA, 2784 bp, Solanum lycopersicum
atgtcggcgaagcttttgtataacttgtcggatgagaatccaaatctgaataaacagattggatgtatgaatgggatctttcaggtgttttaccggcaacattatccaccgagacgtgtcaccggagatgagctcaagtctcttccttcaggcaaagcaagtgacaatgtcggtgataccaacatttcagcggacaagaaggaaacggagaagagtaagaagaagaagactgcaaaggagaaacagaggggagtatcctctgaatcgtcctcgaggttgtcgttttcttcatcaccatgctcctcgagcttctcatctgcagatattagcaccacggcttctcagtttgaacagcccggtttgagtaatggtgagaatcctgtaagagaaccgaccaatgggtcgccaaggtggggcggtttaatgatgccaagtgatataagggagcttgtgagaagctctattcataaggagacaagaaccagagatgaagaagccttgtctcagcagcctaaatcagccagagctaatgtgtctcttctcaaagaatcatcaccatctcggaattctaatgaatggagtgagggacggagagtagtgaagctgaaagacagtcctcggttctcttacgatgagagggagacgagaaagacaggggccaagttgaaagagaccccgaggttgtcattagacagtagatcgaattcctttaggagcgcaagatctagttgttcaccagagccacaagagcttgtaacaggtcacagaagaacaacatcaagcgtcgttgcaaaactgatgggtcttgaagtaattccagatgagcctgtgaccattcagaatagagaaaatcgcttctgcgactccccgaggccaacttcccgagtggaagtagatctacaaagatcaagaggttttgattcaatcaaaaagatgatgcctgctaagtttcctatgaaagcatctccatgggcgcaagttgatggtgccaagaaccaagtcaaaataccagacgctactacgctgacagtttatggtgagatacagaagcggctttcacagcttgagttcaaaaagtccgagaaagacctcagggctcttaagcaaatactcgaagcaatggagaagacgcagcagttgataagcaaagatgatgatgacaacaaaactctatgttcaagcaattttatgcagagaaataatcagccaattccatctgcaataaacacctcgtccatgaattttaaatcatcctctatcgtggttatgaaagcagctaccgctccagtcttcaaagacacaggcattgcaggttctgcgtctttctccccgcggaatgttgctttaccaaatgtcaaggttggaaacctgaggcaagcccagaaagtcattccgaggaagcagagtgctatggatgtgaccccgaggccaggatattacaagggccagacagaatccacaatgaaaaacactagtaccagaccattacaatcgaaaagcgacatggccaagtcagggaagatccagaagcctagtgtcagcctaagaacaccaccaaagaagcttgggttcgagaagcagtctcggccaacatccccaaaaccagaactgaacaagaaccagagacaacaactcagtaggcaacagacagagtcagcctccccgagaagaaagccagggataaaatctcgtggcctacagcaatctgaagaccgtttaagtgatgaaagcagtgacttgagaagtctaagatctgacagcaacgtaagcttggcctctaaccttgatactgaggttacaagcaggtataactatgagaggaacagcgacattacggagcagcacaccccgaaacaaaggagtccagacttgggaatgaggtcgctgtcaaaacctctgaaagttacagtggagcagcccagcccggtgtcagttcttgatgtagctttcgacgaagatgattcaccatcccctgtgcggaagatatccattgtctttaaagaggacgacaatctaagttctgaagagtcccattggatgaacaagaacaacaacttatgtagatcgattgtgtggcctgagagtaacacgagtctaaagcaacctgatgctgaacttacggagggtttcatggaagacgatgccgaattcaaaaatggtgaccacaagtacatctcagagataatgttggcatcagggcttctacgagatatcgactacagcatgataagcatccagctgcaccaagcacacctaccgatcaacccgagccttttctttgtactggaacagaacaagacaagcaatgtgagtctacaggacaacaagcacaaaggcagaggatttggacaacaacaaacggtgaacctggttgagagaagtaagaggaagctcatatttgacaccatcaacgagatcttagctcacagattcgctgcagaagggtgtacaaagcaaccatccataacattatcaatcagcacgcaaaggacacacgaaaaaagttcaagaggggaagagcttctgcaaactctgtgttcagagattgatcgattacaagataactcaaagtgtatcttggatgaggacgatgaagacctcatttgggaggatctgcaaagccatggcatgaactggaaggagattgaaggagagacaccagggttagtgttagacattgagaggctaatcttcaaagacttgattggtgaagttgtgacaagcgagtttgcagcttttccaaggatgctcagtgggcaaccaaggcagctttttcattgctaa

SEQ ID NO: 40 - DNA, 4192 bp, Solanum lycopersicum
gagctttgtcataaattttatttgtaagaataataaaaaattcaattacattctcttacaatgtataaatctacggatacacacgaatacatgtgtacacgcatgtgtatgtacgtactacataacattattacataaccgatgtttttatatcgcttgaaaagcttctccatataattgtagagagagctctttgccttttacagactcacttctcacaaagaacaacaacaaccaaaaaaaaaagatatcattattttcttcttctcttctttcttcttcaaggaaccctccaagagaacatacacagagaaacctaattccttgtctgctcataacttcacaagtagctttacctttgtcttaatgctgggttcttctttgtcctcctgtctcttcttcttcttcttctactacttcctctgagacacaaaacagaggagataacagagtggagattttcaagaattggtaatgagaagaatcttaaagttccaaagtttttcagagtcaacaaccttctgaggccagagttaagaagacaaagaagtagaagaagaagatgtcggcgaagcttttgtataacttgtcggatgagaatccaaatctgaataaacagattggatgtatgaatgggatctttcaggtgttttaccggcaacattatccaccgagacgtgtcaccggagatgagctcaagtctcttccttcaggtaacactctctctctcttttctctttcttagcttgctatgtcctctccatcaaaacctgaagaaaaattatacgtttgagaggaaaaagttcttcaacataagacattgtttttgtattctagttcctgactaagatcctaaaaacaaggttcaggaccactaaagatgcaagaaaccaaagctctataacatgtcttgtctttagaattctctatacttatctataggtgtattatctaacaaaactacgtatttgttaaaagttgaaatttggtggggaaatttttgcaggcaaagcaagtgacaatgtcggtgataccaacatttcagcggacaagaaggaaacggtaagaatctgtcgccagtagagaaatagtattttccatgaaggaaaatgaatattaatagtgaaatttactggaattgcaggagaagagtaagaagaagaagactgcaaaggagaaacagaggggagtatcctctgaatcgtcctcgaggttgtcgttttcttcatcaccatgctcctcgagcttctcatctgcagatattagcaccacggcttctcagtttgaacagcccggtttgagtaatggtgagaatcctgtaagagaaccgaccaatgggtcgccaaggtggggcggtttaatgatgccaagtgatataagggagcttgtgagaagctctattcataaggagacaagaaccagagatgaagaagccttgtctcagcagcctaaatcagccagagctaatgtgtctcttctcaaagaatcatcaccatctcggaattctaatgaatggagtgagggacggagagtagtgaagctgaaagacagtcctcggttctcttacgatgagagggagacgagaaagacaggggccaagttgaaagagaccccgaggttgtcattagacagtagatcgaattcctttaggagcgcaagatctagttgttcaccagagccacaagagcttgtaacaggtcacagaagaacaacatcaagcgtcgttgcaaaactgatgggtcttgaagtaattccagatgagcctgtgaccattcagaatagagaaaatcgcttctgcgactccccgaggccaacttcccgagtggaagtagatctacaaagatcaagaggttttgattcaatcaaaaagatgatgcctgctaagtttcctatgaaagcatctccatgggcgcaagttgatggtgccaagaaccaagtcaaaataccagacgctactacgctgacagtttatggtgagatacagaagcggctttcacagcttgagttcaaaaagtccgagaaagacctcagggctcttaagcaaatactcgaagcaatggagaagacgcagcagttgataagcaaagatgatgatgacaacaaaactctatgttcaagcaattttatgcagagaaataatcagccaattccatctgcaataaacacctcgtccatgaattttaaatcatcctctatcgtggttatgaaagcagctaccgctccagtcttcaaagacacaggcattgcaggttctgcgtctttctccccgcggaatgttgctttaccaaatgtcaaggttggaaacctgaggcaagcccagaaagtcattccgaggaagcagagtgctatggatgtgaccccgaggccaggatattacaagggccagacagaatccacaatgaaaaacactagtaccagaccattacaatcgaaaagcgacatggccaagtcagggaagatccagaagcctagtgtcagcctaagaacaccaccaaagaagcttgggttcgagaagcagtctcggccaacatccccaaaaccagaactgaacaagaaccagagacaacaactcagtaggcaacagacagagtcagcctccccgagaagaaagccagggataaaatctcgtggcctacagcaatctgaagaccgtttaagtgatgaaagcagtgacttgagaagtctaagatctgacagcaacgtaagcttggcctctaaccttgatactgaggttacaagcaggtataactatgagaggaacagcgacattacggagcagcacaccccgaaacaaagggtataaacttttctcctaaagcaaatttctcttttacaagttattcacaagtacatgtttcacaagaatcttgtccatttatcaatgcagagtccagacttgggaatgaggtcgctgtcaaaacctctgaaagttacagtggagcagcccagcccggtgtcagttcttgatgtagctttcgacgaagatgattcaccatcccctgtgcggaagatatccattgtctttaaaggtgagtcactgggaaggtccaaaaaattcagactggcattcaacttttcttcgagccaaaaaaagaaatgttaaactacaagttcataaatattaaactcgttacatttgtccaagatatattcaaaacagattgcaagttttgatttgtttaaagtttctcacctttactatctctcttgtcacagaggacgacaatctaagttctgaagagtcccattggatgaacaagaacaacaacttatgtagatcgattgtgtggcctgagagtaacacgagtctaaagcaacctgatgctgaacttacggagggtttcatggaagacgatgccgaattcaaaaatggtgaccacaagtacatctcagagataatgttggcatcagggcttctacgagatatcgactacagcatgataagcatccagctgcaccaagcacacctaccgatcaacccgagccttttctttgtactggaacagaacaagacaagcaatgtgagtctacaggacaacaagcacaaaggcagaggatttggacaacaacaaacggtgaacctggttgagagaagtaagaggaagctcatatttgacaccatcaacgagatcttagctcacagattcgctgcagaagggtgtacaaagcaaccatccataacattatcaatcagcacgcaaaggacacacgaaaaaagttcaagaggggaagagcttctgcaaactctgtgttcagagattgatcgattacaagataactcaaagtgtatcttggatgaggacgatgaagacctcatttgggaggatctgcaaagccatggcatgaactggaaggagattgaaggagagacaccagggttagtgttagacattgagaggctaatcttcaaagacttgattggtgaagttgtgacaagcgagtttgcagcttttccaaggatgctcagtgggcaaccaaggcagctttttcattgctaatattcctaattaatcttcacttagaattgtaaatcaaggaatctaaatcatccattttacagagttgagaacatttggtttcttggttctctgaacccctttcttatgttcttttcttagttgtttatgtaaacttcataaaaatgttttgtaaaagactccactcaagataaagctcaacaatgttatatcca

SEQ ID NO: 41 - protein, 648 aa, Solanum lycopersicum
MSAKYNSDNNNKIGCMNGIVYRHYRRVTGDKSSGKASDNVGDTNISADKKTKSKKKKTAKKRGVSSSSSRSSSSCSSSSSADISTTASGSNGNVRTNGSRWGGMMSDIRVRSSIHKTRTRDASKSARANVSKSSSRNSNWSGRRVVKKDSRSYDRTRKTGAKKTRSDSRSNSRSARSSCSVTGHRRTTSSVVAKMGVIDVTINRNRCDSRTSRVVDRSRGDSIKKMMAKMKASWAVDGAKNVKIDATTTVYGIKRSKKSKDRAKIAMKTISKDDDDNKTCSSNMRNNISAINTSSMNKSSSIVVMKAATAVKDTGIAGSASSRNVANVKVGNRAKVIRKSAMDVTRGYYKGTSTMKNTSTRSKSDMAKSGKIKSVSRTKKGKSRTSKNKNRSRTSASRRKGIKSRGSDRSDSSDRSRSDSNVSASNDTVTSRYNYRNSDITHTKRSDGMRSSKKVTVSVSVDVADDDSSVRKISIVKDDNSSSHWMNKNNNCRSIVWSNTSKDATGMDDAKNGDHKYISIMASGRDIDYSMISIHAHINSVNKTSNVSDNKHKGRGGTVNVRSKRKIDTINIAHRAAGCTKSITSISTRTHKSSRGTCSIDRDNSKCIDDDDIWDSHGMNWKIGTGVDIRIKDIGVVTSAARMSGRHC

SEQ ID NO: 42 - DNA, 3270 bp, Oryza sativa Japonica Group
atgccggccaagtacttgcagatgctcggggaggagaggcggccggagcttcaccggcagcaggcggggtgcgtcaccgggatcctgcaggcgttcgaccgccggtatcccctcgccgcccaccattcccacaatcgccttcttcccccagcccatgcactgtcaagcagtccaagtgttggggaagagcgaacaagatattcatctcagattgttcttgacaagaacatgagtaaaagctggatcgataatcaaagagcaccattaacagtggagttgtcgcaaggatcttattcatcgtcgtcttgttcttcgtcgtcctcccttgatggaaacagatcaggacagcaagacctatcctccactgatcgaatgctatttccggagaagccattcaaaagctcaccgaagctcaagagctcttctgacagtgactgtggagtggattactaccttgatgatgcccttgccaagctctcagcccaacctagctacccaactcttggtataagaaatctcgtaaaggattcaatatatagagatactcgtgatttttcaatcagaactttcaccaaagaggcagaaaaagatcacctattcaattgtggagatccgcctagaatcttgaatgagcctcctaacagtgctatccaagagaaaaacaaaggaaccatggacattgacgaatccctccgagttttagccaagctcaggaatccatctgaatcagtccagcaaccaaggctatcatatgatgctcctcgcttctcgtgtgaaggaagggaatcagcgtcaaaacttagggaggtgccaagattgtcactagacataaaggaaagccctcttaggaaccgcgaaatcgacgtaaggccaaagccaagcatgactgatgaagacaggagaagcagcatcagtaaagattacagtccacccttggagacccagcaagaacacaatgcctgtaaacgtctccctagcgttgttgcgaaactcatggggttggaagacttgccagagcataaggacaatactgcgatatcttcacaggtatccaaatcagttacagagaggagtgaagaacccaccatgctgaggcctttgagcctttcttcccaaaatgaggctactcctaggcagcagaggaatctagatgcaacaatcaagaatgttcctaactctaagttccctgtggaaactgcaccttggaaacagcaggagaagattgtgctacctagaaaattgccgaagggatcaaagggagctcatggaaaagagcaacatgctgcatcagtttacagtgagatagagaaacggctcaaggaccttgattttcagcaatcgaacaaggatctcagggcactcaagcagatcctggactcgatgcaagcgaaagggttgttgcagaacaagaaacgtgaggaaccatcgatgccgaagatatatgatggagaccatgataacggagatgtgactgatgtaaacctgagactgaatagcaccagcaacaccaaacaggcacctgaaggaaccccatcatttacaacggaagaagatagcactacagaaagaagcttcaaatcacccattgtaatcatgaagcctgcaaaatctgcagacctgttaagtgatgtaaccgaggattccgctgttggtccattaggcggtttatcagagctaccgcagctgagaacagccaatagtgctgataaaaggaaaagctcaaagaaggtcactagggaagctgtggagcaacataccaaatctagttcaagggcacctacacctcaacaccttgcttcttttgacaagagagcaaatggaaggaatgaagaaattagcaggaaacagaagtctacttcacagctgatgactgagaactcagctaggagacagcagatgcaaagagaaaataatggaagcttgctaaagcataaaaattccactagccctagagtacaacagaaaaaacctgattcagagcggagggccagaccgccaattccctctcccgattcaagcaagaatcaaaggcaatctgtggaaaggagccatttggattcagtatcacccagaagtaaatttagaagaaaacctgctcaagcacaaggtgaagatttccatcaaaatggtgtaagtagaaggacaaggagcctgaaccaggaaggcaatgatatgtccgcaaggtcagatggtagcataagtgttgcatcagagctggatgtagaagtgacaagtacagacagatctgcagaagttaacattttgagatctcagcatggcactcaaacaccatcaggaaggaatcctcaaaaagtgaaaacctcttatgatgcaaacaaggacctgccatctatggatcctgcagcaactattactgagcggcctagtccagtctctgtattggactcttcgtttgatcaggaggaatttttccataccagcaagaccacaaattcatctaatgttgatgatgagcatcacccatcaccatcagaagagtcctgcaagccttctgaaaagaagtccacagagctccccacacaacccaagaacagcaagctcgcaaacatagccagcctccttaagaagctccagcaattgagcgtaaacaaggatgaggcacctcctgtcgatcacattgccttcttgtgcgagacgccaagcccagaccatcgctacgtatccgagattctactggcgtcagggcttctgatgaaagaccttggttcagggctgtcacaaatgcagctccacacatcaggctaccccatcaaccctgacctgttctttgttcttgagcaacgaaaatctgggtggacatccaaacctgaggggatccatcagagcaggagcaccacaaagccagatgatcccaagagagcgcaccggaagctaatgttcgaggcggtgaacgagcttctccttgacaagtttgagaaggaaaccacactcatcactggagtagcagcaagggatccagtgatgagcagcgggcagcagctggtgaagatgatatgctccggcatcgaatgcctgaagacggagagatcgcgcatgtgccaagaagacagcagcgtgatccctgacgcagagatcctcaacaggttggaagggtggtcgccgagcttcatcaggagggagcttccaggcatggtgctggagatcgagaggtcgatattcaaggagctcgtcgacgaggtggtgcgcggcgagtccgccgacggtcagccggcgaaggccggaaggcgcagaaggaggctcttcgcttga

SEQ ID NO: 43 - DNA, 6051 bp, Oryza sativa Japonica Group
gagcttcacatcacaagtcttccttccttccttccttgtcgtctgctagttactccatgtcacactagtctcacacaggagcagcaacaagaagaggaagaataggtggaggaggaggaaggccgttcttggtgcttgtgcagcagcttcttgcactcacacttgttctccagtgaggccattgatgttcctgatgctcacacagtcacaagatcccctccctctgggctggttcattcattcagagaagatttgctgagatgttcttgttggtgtgcttgagctggtagcaagggcgccactggttggtggctccacctccctgcattcctggaatttcttgggatttctcctcctcttgaggcggtggtggttgctgagatgccggccaagtacttgcagatgctcggggaggagaggcggccggagcttcaccggcagcaggcggggtgcgtcaccgggatcctgcaggcgttcgaccgccggtatcccctcgccgcccaccattcccacaatcgccttcttcccccaggtgcttgctttgcttcccccacttctcctagtgctattgctcggttcaaagatgcaattttttttttaccttccttttctgttcattctgctacatcgagatttttttaattgtttgcatttctctgtacaatcagtagactatcagtcttgatttgacttgtgtgtgcataaaagacttggtctttggtgtttgatatgtgtaattgaaggcttataaacccataattggtgtgaaagatgagtgaagttgcttggtctcagaagcttccaaaatcttcatgtcagggttgtatggatgggtgctatgcatgctcctggtgttccttcatcctgcattgaattgctaggtgttgatgacaattagtgagatctagctttttccccaattttgggccaggtgccggattttacaggtgcatttagtttttgtgagagtgagatggaagtttttctctggaatctttagcagctactaagatttttttaaaaaaatctgtactagtgctaaatagctgggagttggtcgcagcagccgacaaaagagagagagagaaagagagccattacaccctgtagacagattattaagagcctggttttggataataaatctatctcacaaatgttgacagcactaattattaaattacaagaaggttctttccgagaaatgtggctgtttggatgaactacgacattgacatatttgttttttctttgtttcatttaatttgtagccatttgaagatgtttttttaatcggaagatcccttctaatatttcaattctctgaaacagcccatgcactgtcaagcagtccaagtgttggggaagagcgaacaagatattcatctcagattgttcttgtaagtttcaatatttcttcttacattcaataggcatggatgcattgtttattgtcttctacaatctgtttgactggctgcaatctgcattcaggacaagaacatgagtaaaagctggatcgataatcaaagagcaccattaacagtggagttgtcgcaaggatcttattcatcgtcgtcttgttcttcgtcgtcctcccttgatggaaacagatcaggacagcaagacctatcctccactgatcgaatgctatttccggagaagccattcaaaagctcaccgaagctcaagagctcttctgacagtgactgtggagtggattactaccttgatgatgcccttgccaagctctcagcccaacctagctacccaactcttggtataagaaatctcgtaaaggattcaatatatagagatactcgtgatttttcaatcagaactttcaccaaagaggcagaaaaagatcacctattcaattgtggagatccgcctagaatcttgaatgagcctcctaacagtgctatccaagagaaaaacaaaggaaccatggacattgacgaatccctccgagttttagccaagctcaggaatccatctgaatcagtccagcaaccaaggctatcatatgatgctcctcgcttctcgtgtgaaggaagggaatcagcgtcaaaacttagggaggtgccaagattgtcactagacataaaggaaagccctcttaggaaccgcgaaatcgacgtaaggccaaagccaagcatgactgatgaagacaggagaagcagcatcagtaaagattacagtccacccttggagacccagcaagaacacaatgcctgtaaacgtctccctagcgttgttgcgaaactcatggggttggaagacttgccagagcataaggacaatactgcgatatcttcacaggtatccaaatcagttacagagaggagtgaagaacccaccatgctgaggcctttgagcctttcttcccaaaatgaggctactcctaggcagcagaggaatctagatgcaacaatcaagaatgttcctaactctaagttccctgtggaaactgcaccttggaaacagcaggagaagattgtgctacctagaaaattgccgaagggatcaaagggagctcatggaaaagagcaacatgctgcatcagtttacagtgagatagagaaacggctcaaggaccttgattttcagcaatcgaacaaggatctcagggcactcaagcagatcctggactcgatgcaagcgaaagggttgttgcagaacaagaaacgtgaggaaccatcgatgccgaagatatatgatggagaccatgataacggagatgtgactgatgtaaacctgagactgaatagcaccagcaacaccaaacaggcacctgaaggaaccccatcatttacaacggaagaagatagcactacagaaagaagcttcaaatcacccattgtaatcatgaagcctgcaaaatctgcagacctgttaagtgatgtaaccgaggattccgctgttggtccattaggcggtttatcagagctaccgcagctgagaacagccaatagtgctgataaaaggaaaagctcaaagaaggtcactagggaagctgtggagcaacataccaaatctagttcaagggcacctacacctcaacaccttgcttcttttgacaagagagcaaatggaaggaatgaagaaattagcaggaaacagaagtctacttcacagctgatgactgagaactcagctaggagacagcagatgcaaagagaaaataatggaagcttgctaaagcataaaaattccactagccctagagtacaacagaaaaaacctgattcagagcggagggccagaccgccaattccctctcccgattcaagcaagaatcaaaggcaatctgtggaaaggagccatttggattcagtatcacccagaagtaaatttagaagaaaacctgctcaagcacaaggtgaagatttccatcaaaatggtgtaagtagaaggacaaggagcctgaaccaggaaggcaatgatatgtccgcaaggtcagatggtagcataagtgttgcatcagagctggatgtagaagtgacaagtacagacagatctgcagaagttaacattttgagatctcagcatggcactcaaacaccatcaggaaggaatcctcaaaaagtggtaaacaattttccttcctccagttggctctttcatccatattcatagatgatgttattaatgtaaaaacacagtattattcttcctaattttcaccttcctattatctaaaaaaatattcacctttgtaacagcaaaaacatatattttaggaagagctacaatatttggtcatagttcttctgtaaaatgaaatctgtccaactctagttgggttcaagctggaaatttgaaatcgtacaaacataccataactcttgtctaattatgaccttttttaaacttaaattcagaaaacctcttatgatgcaaacaaggacctgccatctatggatcctgcagcaactattactgagcggcctagtccagtctctgtattggactcttcgtttgatcaggaggaatttttccataccagcaagaccacaaattcatctaatgttggtaagatctgctgcttcatactacttggttcatcgatcatataaagtggagtattagtacttttcaaaagaaaatgggaactcgaataggttttccggagtgtcctttgaattacttcctgctttgatgtcttagttttccagagttggttggttatggaacttcttgtgtaaaggtttacatgactcatgtctgctgatgtttacatgactcgataattaggtttcttcatattaattttcgacaagtagtaacgctggcagtgggttgaggttcacgtgcacatagtaagcaaatagagatctcctgctaccaatagtgttcctctcatatagaatggtgtgtgcattatgcaccatagttatagggttttgaaatttcctcaaggagggaaagaacataactgagagttgacaaaaatcctactgtggtgtactatgattgcacctaccactaccaatcaaaagatctcctgtatgcatagttcctttacaatttatccacatggcttgctagataaagtgatatgtcgtaatgcaagtatgcaacccccaagtaatgtgaacagtagagtttcaatgatagagtgcttgtcgttttttctgcagtagcattaggcacattcttaatttcattaatgttgcaatatcagtatggagtgctaaagaatctgccttcagaccagcgattagttgctgcacgacatgttgttttgacaacagaacaaggagaattacaagggccgcagcatttaatgtactatatttgacacggatgcggaatgaatatcagttcaagaatgctttagtttttgtctttatgcatctttagatgcatctgctgggatattatcattccattatctgaaaaagagaagtagaaaacgcatgaacctaacatggtggactggttactgaaattgttaccagtggtattgatattgtgttccaaagactgaaacctaatttcttgaaatttgcagatgatgagcatcacccatcaccatcagaagagtcctgcaagccttctgaaaagaagtccacagagctccccacacaacccaagaacagcaagctcgcaaacatagccagcctccttaagaagctccagcaattgagcgtaaacaaggatgaggcacctcctgtcgatcacattgccttcttgtgcgagacgccaagcccagaccatcgctacgtatccgagattctactggcgtcagggcttctgatgaaagaccttggttcagggctgtcacaaatgcagctccacacatcaggctaccccatcaaccctgacctgttctttgttcttgagcaacgaaaatctgggtggacatccaaacctgaggggatccatcagagcaggagcaccacaaagccagatgatcccaagagagcgcaccggaagctaatgttcgaggcggtgaacgagcttctccttgacaagtttgagaaggaaaccacactcatcactggagtagcagcaagggatccagtgatgagcagcgggcagcagctggtgaagatgatatgctccggcatcgaatgcctgaagacggagagatcgcgcatgtgccaagaagacagcagcgtgatccctgacgcagagatcctcaacaggttggaagggtggtcgccgagcttcatcaggagggagcttccaggcatggtgctggagatcgagaggtcgatattcaaggagctcgtcgacgaggtggtgcgcggcgagtccgccgacggtcagccggcgaaggccggaaggcgcagaaggaggctcttcgcttgacagtcactagtgatggctgctgacttgcattggagtgcgaagcgtgaagcgagtgtaactgtgatactgtacctagtagtagcatgtccattgttgaggtttgatttgtccagagagagagagagagagagaggaggaagagcaatgcagaaacctgaagtaggaatgcaatgtttgaggcacttgcctagttgttgttctgcgataaatattataagtgaaattataacc

SEQ ID NO: 44 - protein, 1089 aa, Oryza sativa Japonica Group
MPAKYLQMLGEERRPELHRQQAGCVTGILQAFDRRYPLAAHHSHNRLLPPAHALSSSPSVGEERTRYSSQIVLDKNMSKSWIDNQRAPLTVELSQGSYSSSSCSSSSSLDGNRSGQQDLSSTDRMLFPEKPFKSSPKLKSSSDSDCGVDYYLDDALAKLSAQPSYPTLGIRNLVKDSIYRDTRDFSIRTFTKEAEKDHLFNCGDPPRILNEPPNSAIQEKNKGTMDIDESLRVLAKLRNPSESVQQPRLSYDAPRFSCEGRESASKLREVPRLSLDIKESPLRNREIDVRPKPSMTDEDRRSSISKDYSPPLETQQEHNACKRLPSVVAKLMGLEDLPEHKDNTAISSQVSKSVTERSEEPTMLRPLSLSSQNEATPRQQRNLDATIKNVPNSKFPVETAPWKQQEKIVLPRKLPKGSKGAHGKEQHAASVYSEIEKRLKDLDFQQSNKDLRALKQILDSMQAKGLLQNKKREEPSMPKIYDGDHDNGDVTDVNLRLNSTSNTKQAPEGTPSFTTEEDSTTERSFKSPIVIMKPAKSADLLSDVTEDSAVGPLGGLSELPQLRTANSADKRKSSKKVTREAVEQHTKSSSRAPTPQHLASFDKRANGRNEEISRKQKSTSQLMTENSARRQQMQRENNGSLLKHKNSTSPRVQQKKPDSERRARPPIPSPDSSKNQRQSVERSHLDSVSPRSKFRRKPAQAQGEDFHQNGVSRRTRSLNQEGNDMSARSDGSISVASELDVEVTSTDRSAEVNILRSQHGTQTPSGRNPQKVKTSYDANKDLPSMDPAATITERPSPVSVLDSSFDQEEFFHTSKTTNSSNVDDEHHPSPSEESCKPSEKKSTELPTQPKNSKLANIASLLKKLQQLSVNKDEAPPVDHIAFLCETPSPDHRYVSEILLASGLLMKDLGSGLSQMQLHTSGYPINPDLFFVLEQRKSGWTSKPEGIHQSRSTTKPDDPKRAHRKLMFEAVNELLLDKFEKETTLITGVAARDPVMSSGQQLVKMICSGIECLKTERSRMCQEDSSVIPDAEILNRLEGWSPSFIRRELPGMVLEIERSIFKELVDEVVRGESADGQPAKAGRRRRRLFA

SEQ ID NO: 45 - DNA, 2517 bp, Oryza sativa Japonica Group
atgtgggtcccacctgtcatccacctgcacggccagctaggccaacgtctcgcccgatgcgtgcgcgcgtaccccgacgcgtcgacaggacgcgatggcaatgtaccgcgaataccgcgaagaccgaggggtagtaccgtcatttcgtccccccgcccccccgctttaaaatcgtcccaaaagcgggagctcctccttccgccctcgtcgacggcgagcgacacgccgagacacccacagagcgccgcccgcgccgccgcgaggagaggagacggagaggtgaggaggaggagaggagagatggtggcgatgggcgcggacgaggaggaggagcggcggatgcaccagggctgcatggccgggttcttccacctgttcgaccgcccgcagatactctccggcaagcgcctccatcaccagcctcgccgcctcctgtcatcctccagcgggtcggcgacgccgtcggagaggtcgatgcagctggaccggtcgccggagcgggcgacgccgctgccgtcgcccgacatgacgccaccggctgcgccgaggccgtcgctgcagctgccgccgctggagacgaaggacgggggtggcgcgcccgcggtgtggcggctgccgcggctgtcgctggacagccgcgcggtggtggacgccagggggaagctgcggccgcgcgacatccggacgtcgcccgccgcgccgccgtccccgggggccggcggcggggacgagcgacgctcgcccagcgtcgtcgcgcggctcatgggcctcgacgcgctgccgcgtggcgctccggacgagcgggacgcggcgccgtgtgggggtgagctccggcggtcggcgtccgagcgcgtgccgcgtgacccggcctgcttcaggttcgttgacccgagcttcttcgagaggccctcgccgccggtgacgccgcagcagcagaggccgtcttcgccggcggtcgaggcggcgctgcggcgcgcgccggatcccgcgtgcccgcgcggtgggattcagaggcgtagccgcttcgacgcgcacgacgtgttcccggagcccgcgaagcgcgtcgtcgactcggccgcggcggggcacggcgagatcgcgctctacggcgagatcgagcggcgcctccgcaagcgcgggatcgccgagccggccagggatctggagacgctcaagcaaatcttggaggcgctccagctcaagggcctcctccgccacaccccgccgccgccggtctcgtcgctacgcacccagccgccgccgcctcctatcgtcgtcatgcggccctcgtcgcggccgccacagccgccggcgtcgcggacgtcgcccacccgccgagtccgcgtcgacgccgacaatgcccggcgcccgcgctcaccggaccgcgccgcgtcgcccgcacggagcccggcttcccccgctcgacgcggccctcagtccccgcagcgacgcgtctcgccggcgcagtcgccgaggtaccagccgccgctcaggaagccgagcaccggcgaccgctcccgcattgcccgccgcggaggtcacggcagcgcggcgctgtctcccgacgacgacgcgtccaccaccttctccgacggcaccagcagcggctcactcagcgcctcctcccgctgggacttcgaggtgagccctcctccacctccaatggcggccaccatttcggaatttctctcgtctaacgaaagcttcgcaatgcagcagcgcgcgcgccccgacgagctccgcaccgaccgcggccttctcgagcgctgcggcaagctgctgagcagcatccaggcgttcaccgccggcgacgaccagcagccgagcccggtgtccgtgctcgacgcggcggcgttcctcgccgacgaggactcgccgtcgtcgtcggggtcgaagcgcgccatcttcttcggcgccgccgccccggccccgcacgccgcgacggcgtccgcgtccgaccaagacgacgacgacgaccagtgggacacgtggacggtgggcccggacgtcgacccggactacgcctacgtggcggaggtcgtcaaggtgttcgaccggacgacgcgggacccatccgccgtgtacgccgcggcggcgaagaccaccaccggcggcgacgacgacacgtgcccccatcaccggatgctcctctgcgccgcggcggtggaggcgctcgaccgccggcgagccgcctgcgcgtgggacccggtgtcgtggctccgcggcggcgagctggtggaccacgtctgggccgaggtgaggcgcgcgcgcgagcccgtggcggcgccggacgccgacctcgacctgaacgagctgatccgcggcggcgtcgtccgcgacctcgccgccgaccaccaccggtggccgccgtcgtcgtcgcagctgctgcccggcgcggaggtggccgacgccgtgctgcagatcgagcggctggtgttcaaggacctcgtcgccgacaccatccgcgagctcgccgacgtcggcctccgcctgccacgtcggaaactggtcttctaa

SEQ ID NO: 46 - DNA, 2607 bp, Oryza sativa Japonica Group
atgtgggtcccacctgtcatccacctgcacggccagctaggccaacgtctcgcccgatgcgtgcgcgcgtaccccgacgcgtcgacaggacgcgatggcaatgtaccgcgaataccgcgaagaccgaggggtagtaccgtcatttcgtccccccgcccccccgctttaaaatcgtcccaaaagcgggagctcctccttccgccctcgtcgacggcgagcgacacgccgagacacccacagagcgccgcccgcgccgccgcgaggagaggagacggagaggtgaggaggaggagaggagagatggtggcgatgggcgcggacgaggaggaggagcggcggatgcaccagggctgcatggccgggttcttccacctgttcgaccgcccgcagatactctccggcaagcgcctccatcaccagcctcgccgcctcctgtcatcctccagcgttcgtccctctcgccatctctctccggttgaaatggtggcttcgttttcacggggttgctgatgtgggaatggtgtggtgtgtgtgcaggggtcggcgacgccgtcggagaggtcgatgcagctggaccggtcgccggagcgggcgacgccgctgccgtcgcccgacatgacgccaccggctgcgccgaggccgtcgctgcagctgccgccgctggagacgaaggacgggggtggcgcgcccgcggtgtggcggctgccgcggctgtcgctggacagccgcgcggtggtggacgccagggggaagctgcggccgcgcgacatccggacgtcgcccgccgcgccgccgtccccgggggccggcggcggggacgagcgacgctcgcccagcgtcgtcgcgcggctcatgggcctcgacgcgctgccgcgtggcgctccggacgagcgggacgcggcgccgtgtgggggtgagctccggcggtcggcgtccgagcgcgtgccgcgtgacccggcctgcttcaggttcgttgacccgagcttcttcgagaggccctcgccgccggtgacgccgcagcagcagaggccgtcttcgccggcggtcgaggcggcgctgcggcgcgcgccggatcccgcgtgcccgcgcggtgggattcagaggcgtagccgcttcgacgcgcacgacgtgttcccggagcccgcgaagcgcgtcgtcgactcggccgcggcggggcacggcgagatcgcgctctacggcgagatcgagcggcgcctccgcaagcgcgggatcgccgagccggccagggatctggagacgctcaagcaaatcttggaggcgctccagctcaagggcctcctccgccacaccccgccgccgccggtctcgtcgctacgcacccagccgccgccgcctcctatcgtcgtcatgcggccctcgtcgcggccgccacagccgccggcgtcgcggacgtcgcccacccgccgagtccgcgtcgacgccgacaatgcccggcgcccgcgctcaccggaccgcgccgcgtcgcccgcacggagcccggcttcccccgctcgacgcggccctcagtccccgcagcgacgcgtctcgccggcgcagtcgccgaggtaccagccgccgctcaggaagccgagcaccggcgaccgctcccgcattgcccgccgcggaggtcacggcagcgcggcgctgtctcccgacgacgacgcgtccaccaccttctccgacggcaccagcagcggctcactcagcgcctcctcccgctgggacttcgaggtgagccctcctccacctccaatggcggccaccatttcggaatttctctcgtctaacgaaagcttcgcaatgcagcagcgcgcgcgccccgacgagctccgcaccgaccgcggccttctcgagcgctgcggcaagctgctgagcagcatccaggcgttcaccgccggcgacgaccagcagccgagcccggtgtccgtgctcgacgcggcggcgttcctcgccgacgaggactcgccgtcgtcgtcggggtcgaagcgcgccatcttcttcggcgccgccgccccggccccgcacgccgcgacggcgtccgcgtccgaccaagacgacgacgacgaccagtgggacacgtggacggtgggcccggacgtcgacccggactacgcctacgtggcggaggtcgtcaaggtgttcgaccggacgacgcgggacccatccgccgtgtacgccgcggcggcgaagaccaccaccggcggcgacgacgacacgtgcccccatcaccggatgctcctctgcgccgcggcggtggaggcgctcgaccgccggcgagccgcctgcgcgtgggacccggtgtcgtggctccgcggcggcgagctggtggaccacgtctgggccgaggtgaggcgcgcgcgcgagcccgtggcggcgccggacgccgacctcgacctgaacgagctgatccgcggcggcgtcgtccgcgacctcgccgccgaccaccaccggtggccgccgtcgtcgtcgcagctgctgcccggcgcggaggtggccgacgccgtgctgcagatcgagcggctggtgttcaaggacctcgtcgccgacaccatccgcgagctcgccgacgtcggcctccgcctgccacgtcggaaactggtcttctaa

SEQ ID NO: 47 - protein, 735 aa, Oryza sativa Japonica Group
MGADEEEERRMHQGCMAGFFHLFDRPQILSGKRLHHQPRRLLSSSSGSATPSERSMQLDRSPERATPLPSPDMTPPAAPRPSLQLPPLETKDGGGAPAVWRLPRLSLDSRAVVDARGKLRPRDIRTSPAAPPSPGAGGGDERRSPSVVARLMGLDALPRGAPDERDAAPCGGELRRSASERVPRDPACFRFVDPSFFERPSPPVTPQQQRPSSPAVEAALRRAPDPACPRGGIQRRSRFDAHDVFPEPAKRVVDSAAAGHGEIALYGEIERRLRKRGIAEPARDLETLKQILEALQLKGLLRHTPPPPVSSLRTQPPPPPIVVMRPSSRPPQPPASRTSPTRRVRVDADNARRPRSPDRAASPARSPASPARRGPQSPQRRVSPAQSPRYQPPLRKPSTGDRSRIARRGGHGSAALSPDDDASTTFSDGTSSGSLSASSRWDFEVSPPPPPMAATISEFLSSNESFAMQQRARPDELRTDRGLLERCGKLLSSIQAFTAGDDQQPSPVSVLDAAAFLADEDSPSSSGSKRAIFFGAAAPAPHAATASASDQDDDDDQWDTWTVGPDVDPDYAYVAEVVKVFDRTTRDPSAVYAAAAKTTTGGDDDTCPHHRMLLCAAAVEALDRRRAACAWDPVSWLRGGELVDHVWAEVRRAREPVAAPDADLDLNELIRGGVVRDLAADHHRWPPSSSQLLPGAEVADAVLQIERLVFKDLVADTIRELADVGLRLPRRKLVF

SEQ ID NO: 48 - DNA, 2778 bp, Oryza sativa Japonica Group
atgccgtcccggatgatgcaggcgttcgcgcaggaggcttccgacttcgaccggcagatgggctgcatggccggcatgttccagatcttcgaccgccgccgcctcctcaccgcgcgtcaacgcggcggagcccgaggcacggcgccaccaggccatgttttgccaaacagcaacagcaatgtctcgattcaaaacccagttgcttcaaacaacactctggacaaaaccttcagcaaaagtatgaccgagaacagtagcctctccatggaatcatcgcgggcatcttcttcttcctcatcgtgctcttcgttctcgtccacagacatcaacagaccaatacaacaagagctctcctacatcaacaaagagcgttttgctgggaagccaccaagaagctcacagacaaagagtgtgaaatgttccaagacagaggccaaaaccaaagacccacacactggctttagagacattgtcaaggagtccatcaaccgggaaacccatggtatgaccatcaagacgtcgacaaaggagtccagaaaaggattgcacaaagactcaccaaggccgttgctgatctccaaatcaaccgatggaacttacgtgattgggatcgacaggagcaccggcgttcctggatatgttcatgaatccagcaggccaccacgcttctcatgcgacgatcggcaactcctgaggtcggtcgaagcgcaagacagcaagaagccttcagcaaagctcaaggagcttcccaggctgtccttggacagcagaaaagaatccatgaatccatgttcacgtctgaagaactctggctacataagaactgatgacaacctcctggatgttctgaagcaccaagaatcgccgagccatcagcgggccagcagcgtcgttgccaagctcatggggttggaaggaactactcctgacatccatgagacggcaaggtcacctacacctgtccatggcacgcaaattgatcagccgtcacactgtcaaaggatcaagaaccaagatcatagtgtcccggtgcagaagaatcactctccagtactgaaaaccaatccttctccaagaattatccctgaagcagccccatggagacagaatgagagagctgtaacaggacgtgcagctgaagtgaagccaagaactgcatccatctatgctgacatacagagaagactcaggggtctagagttgtcggaatgcaacaaggaactgagggctctcaggatattgagcacactgcacaaaaaggatggcccaagccagagcgacaacaatcctgaattaacagccattcaaaagaaggcctctgaacaaatagttgattctgaaaatttccagtctccaattgtgatcatgaaaccagcaagatgcatcacaaaacctgatgcttcagatactttggttgctcccctttcaaggccaaaaggcataagaagactacggcatgaagagacatctttcaccaggaagaatgaaaacagtgatagcaagagaaatcattctccgaatgaaagtgctcattccagtggtgaggaacctgtaaattctgcaagatcaccaaggctttccagctcattgagccccaggctggcacagaagaaggcggactctgaaaggaggtctcgtccaccggttttgccaacgtcaccaggcaagaaatctaaagaaacagtgtccccaagaggcaggctaagatcaaggcactcgcaaacaaagagcaactctgacaacgataatgtgttacacatccctgaaactaaaatcaatttggcaaagcagatcgatgtgggtgtcgttgatcatccgaatcctctgaatgccaactcaccatatatccatcaaagcaaaatagcttcaacacccaatcgtgaggaaatgcctacaattctacctgcagacaagaagaagatccatccacaggagaacatcccaagtcctgtgtcagttcttgatgcaacattttatcatgaggggtcatcgccttctctgaagagaatctcagattccttcaaagacggcgagacgcatacttcagatgagagttggaacccaacaagcctccctgatacaccaccttcaaaggcaagcaacgatggcaaccagataaaggcagaaaacatgaaagccctcatccaaaagcttgagctcttgcaaatgttgagtgaggaagctctgaaaaccgatgacactttttcatcagttgctgccaataaagatcaccagtacctctacgagatactttcagcatcagggatcctacacaacaaactaaattttcaaatgatgcctcatcagctgcgaccatcaagctacccgattaatccagagcttttcctcatccttgaacaagcaaaaccagacgaagaaaagctgcaccgtaggctcatatttgatcttgcaaatgaactcctcgcccagcaaatggatgccaaccacactgtgaattcatcagtgcagttctttcagtcaaagaagttaagtgggtggcaacttttcaaggacttatgtgcagagattgacatgatccagtctcggtcctcaatgataaggtgctctgaagaggaagatagcaggctagcagaggatgcaatgcaaggcatgaaagagtggaagagctccgacagtgaacggcaaggaattgttttggccattgaaaaatccatctttaaggatcttattgatgagataattagtggagtagacaaagggaaggtgcacctgacgcaatggaagctaaggaggcagctgtctttcatcagcatatag

SEQ ID NO: 49 - DNA, 4676 bp, Oryza sativa Japonica Group
gcaatgccattgcacacatatcttctcgttcttaaatcaagctgctgcctctccctcctcctcttgacaagcaccattcctctcaactgaacctgtcaaacagagagagaagtagatgatagcgtgagagaatagaacagaagaaagaagataaaaaaaaagaaaaggaaaggaaagctctgtgtaaagcctgcatctacgtgctctctttggttggggtgttcttgctgctagaactagcttagcctggttctgccatggagtgaagaggcctctcgttcatctccgattcttgggggttgtcttcagctgttcagcaagagccgagagcttagcttggggcaaaggaaatgccgtcccggatgatgcaggcgttcgcgcaggaggcttccgacttcgaccggcagatgggctgcatggccggcatgttccagatcttcgaccgccgccgcctcctcaccgcgcgtcaacgcggcggagcccgaggcacggcgccaccaggtagtggtaccataccaattcttcttctctgtactcttctgcggcgtgtgctcttcgtgtagctcttcttcttcttcttctttctctctctctctctctctctctctctctctctctctctctcttttgctgccaaagtttatcacaaagacaaaactgaatactaactgtcctgtggagatatgaacagtgttactggcagtagatgctaaactagaacagggattaaaaaattgtttcgtttagaaagtactgctgctgccaagtaagaacaggggaaatttatagggaggtacatggtcatggacaagaaactgacacaagttcagaagctgcaggaatgtagatgtagcacatatgagttgtagtaatgggcaattgcacagtgaataatcagtcaagtaaaaatgaaatggtagtaaagtgaagtgctttttctattcagatatttggtattctttggctgaaacaaatcaatagatttcagtgatatgttcttgatcaaatccaacttttaaaattcagatatctttatgatattgatcttttccttccctcgatcaaattagatatttataatttaactgcggtaactttcttttggtttatacccaaatacagttcatattaataactgtttcctgaatactttctttaggccatgttttgccaaacagcaacagcaatgtctcgattcaaaacccagttgcttcaaacaacactctggtaattttcctactgtactgtgcatgacaaatatatatcccaagtatgcagttcatctgcctcaaacagactggtttttgactcaaaacataatacttacttgtgtaggacaaaaccttcagcaaaagtatgaccgagaacagtagcctctccatggaatcatcgcgggcatcttcttcttcctcatcgtgctcttcgttctcgtccacagacatcaacagaccaatacaacaagagctctcctacatcaacaaagagcgttttgctgggaagccaccaagaagctcacagacaaagagtgtgaaatgttccaagacagaggccaaaaccaaagacccacacactggctttagagacattgtcaaggagtccatcaaccgggaaacccatggtatgaccatcaagacgtcgacaaaggagtccagaaaaggattgcacaaagactcaccaaggccgttgctgatctccaaatcaaccgatggaacttacgtgattgggatcgacaggagcaccggcgttcctggatatgttcatgaatccagcaggccaccacgcttctcatgcgacgatcggcaactcctgaggtcggtcgaagcgcaagacagcaagaagccttcagcaaagctcaaggagcttcccaggctgtccttggacagcagaaaagaatccatgaatccatgttcacgtctgaagaactctggctacataagaactgatgacaacctcctggatgttctgaagcaccaagaatcgccgagccatcagcgggccagcagcgtcgttgccaagctcatggggttggaaggaactactcctgacatccatgagacggcaaggtcacctacacctgtccatggcacgcaaattgatcagccgtcacactgtcaaaggatcaagaaccaagatcatagtgtcccggtgcagaagaatcactctccagtactgaaaaccaatccttctccaagaattatccctgaagcagccccatggagacagaatgagagagctgtaacaggacgtgcagctgaagtgaagccaagaactgcatccatctatgctgacatacagagaagactcaggggtctagagttgtcggaatgcaacaaggaactgagggctctcaggatattgagcacactgcacaaaaaggatggcccaagccagagcgacaacaatcctgaattaacagccattcaaaagaaggcctctgaacaaatagttgattctgaaaatttccagtctccaattgtgatcatgaaaccagcaagatgcatcacaaaacctgatgcttcagatactttggttgctcccctttcaaggccaaaaggcataagaagactacggcatgaagagacatctttcaccaggaagaatgaaaacagtgatagcaagagaaatcattctccgaatgaaagtgctcattccagtggtgaggaacctgtaaattctgcaagatcaccaaggctttccagctcattgagccccaggctggcacagaagaaggcggactctgaaaggaggtctcgtccaccggttttgccaacgtcaccaggcaagaaatctaaagaaacagtgtccccaagaggcaggctaagatcaaggcactcgcaaacaaagagcaactctgacaacgataatgtgttacacatccctgaaactaaaatcaatttggcaaagcagatcgatgtgggtgtcgttgatcatccgaatcctctgaatgccaactcaccatatatccatcaaagcaaaatagcttcaacacccaatcgtgaggtacagaaaattaactgtagtaccacctctaaagaccttactgttatgaaaacattatctggcagtaacaactgattgacaaaacattgtttttcccaggaaatgcctacaattctacctgcagacaagaagaagatccatccacaggagaacatcccaagtcctgtgtcagttcttgatgcaacattttatcatgaggggtcatcgccttctctgaagagaatctcagattccttcaaaggtgaggacttggtctggcaagctattcttctgcaaactttttgagtttttatactgtttgtaactttgtttccatccactaaggaagctcaaactggttaggcataggacaagcatacttagctgtaagcacatccaccaatcatagtgacaggcaaccagtagccaatgcaccaagcatagcttgtggtcctttcagatcggaaggatcacagtaaattgacagttgcagatacacatgtgagtgtttgcttgtgccaaactgttagagagtacaattccttagctgcctgctgttgttcatgtctacagtctgcacctaacatctacaaggaaccccacatgttgcacttgccacgaaggaacatgatagtatgttggttaatgtgcagacatacttatgtagatgagcccaccaattattttgatttttatagatgagacagaatgtcagatagacaagaattatcaacttatcttttctttctttttttcacttgttcagacggcgagacgcatacttcagatgagagttggaacccaacaagcctccctgatacaccaccttcaaaggcaagcaacgatggcaaccagataaaggcagaaaacatgaaagccctcatccaaaagcttgagctcttgcaaatgttgagtgaggaagctctgaaaaccgatgacactttttcatcagttgctgccaataaagatcaccagtacctctacgagatactttcagcatcagggatcctacacaacaaactaaattttcaaatgatgcctcatcagctgcgaccatcaagctacccgattaatccagagcttttcctcatccttgaacaagcaaaaccagacgaagaaaagctgcaccgtaggctcatatttgatcttgcaaatgaactcctcgcccagcaaatggatgccaaccacactgtgaattcatcagtgcagttctttcagtcaaagaagttaagtgggtggcaacttttcaaggacttatgtgcagagattgacatgatccagtctcggtcctcaatgataaggtgctctgaagaggaagatagcaggctagcagaggatgcaatgcaaggcatgaaagagtggaagagctccgacagtgaacggcaaggaattgttttggccattgaaaaatccatctttaaggatcttattgatgagataattagtggagtagacaaagggaaggtgcacctgacgcaatggaagctaaggaggcagctgtctttcatcagcatataggccaaatttctgcttcttaggaagcttagctaatggtatatgtaaccgttttaaactggctatacaatccatgagttaactgacatatatatatctacatgagcaagcaaacagtaacactgagatcttgccaaccaaaaaaaaaaatatccaaagattccctcgaagatgttccctgg

SEQ ID NO: 50 - protein, 925 aa, Oryza sativa Japonica Group
MPSRMMQAFAQEASDFDRQMGCMAGMFQIFDRRRLLTARQRGGARGTAPPGHVLPNSNSNVSIQNPVASNNTLDKTFSKSMTENSSLSMESSRASSSSSSCSSFSSTDINRPIQQELSYINKERFAGKPPRSSQTKSVKCSKTEAKTKDPHTGFRDIVKESINRETHGMTIKTSTKESRKGLHKDSPRPLLISKSTDGTYVIGIDRSTGVPGYVHESSRPPRFSCDDRQLLRSVEAQDSKKPSAKLKELPRLSLDSRKESMNPCSRLKNSGYIRTDDNLLDVLKHQESPSHQRASSVVAKLMGLEGTTPDIHETARSPTPVHGTQIDQPSHCQRIKNQDHSVPVQKNHSPVLKTNPSPRIIPEAAPWRQNERAVTGRAAEVKPRTASIYADIQRRLRGLELSECNKELRALRILSTLHKKDGPSQSDNNPELTAIQKKASEQIVDSENFQSPIVIMKPARCITKPDASDTLVAPLSRPKGIRRLRHEETSFTRKNENSDSKRNHSPNESAHSSGEEPVNSARSPRLSSSLSPRLAQKKADSERRSRPPVLPTSPGKKSKETVSPRGRLRSRHSQTKSNSDNDNVLHIPETKINLAKQIDVGVVDHPNPLNANSPYIHQSKIASTPNREEMPTILPADKKKIHPQENIPSPVSVLDATFYHEGSSPSLKRISDSFKDGETHTSDESWNPTSLPDTPPSKASNDGNQIKAENMKALIQKLELLQMLSEEALKTDDTFSSVAANKDHQYLYEILSASGILHNKLNFQMMPHQLRPSSYPINPELFLILEQAKPDEEKLHRRLIFDLANELLAQQMDANHTVNSSVQFFQSKKLSGWQLFKDLCAEIDMIQSRSSMIRCSEEEDSRLAEDAMQGMKEWKSSDSERQGIVLAIEKSIFKDLIDEIISGVDKGKVHLTQWKLRRQLSFISI

SEQ ID NO: 51 - DNA, 2631 bp, Sorghum bicolor
atgccgactagaatggcaaaggccttctcccatgaggccacggaatttggcggccagatggggtgcgtggccagcatgctccacatcttcgaccgccgccgccttctcaccggccgacgacatggtgactgccctggaaccaaggacgaggacgaactgcctccagcaggccatactctgccggttagcagcacgcatgccccggtgcaaagcacagctaatccaaacaacactgtggagaaatcgttcagcaaaagcaaaagcaaaagcatgactgagaacagtaccttctcaacagaatcatcgagagcatcttcagcatcgtcgtcctgctcttcattatcacccctggccaacagcaaaccagtacagcagaagctcccttgcatcaacgagaagcatgtcgtagcaaggagtaggacaatgaggagctcgcgaagctttaagtcttcagatacagaggtcaaatccatacagcaaaaaactgattttagagatgtcgtgaaggactccatcaaccaggactctcgtgtcctggccatcaagactaaaatgatggaacagagagatggactgcacaaagactcaccaaggccactgcttatatccaaatcaacagatggaacttatgtgattgctgttgataggagcaatgtgcctcctgcatatgtcaatgaatctagcaggcagcaacgtttatcatgtgatgatcgacagctgctgctgcaggtagaagctcaagacagcaagatgccttcatccaagcacatggagcttcctaggctgtccttggacagtaggaatgagtctgtcaagtcaagtttgcatcagaagaactttggttatgcaagaaccgatgacagtctcattgataatttgaaataccaagaatccccgagccatcggcgggccagtgctgtcgttgcaaagctcatgggattggaagagactctcgatgcccctgggtctgcaagatcacacagaccagaccgtcacactcgaaataattacctgccacacacctccaggagtatctgccatgacctcagtacattgcagccgaagattcagcctacaatactgaaaaccaaaccttctccgagaattgtccctgaagctgcagcttggaagcagcagaagataaatacagctagatattattctaaagaagggccaagttctacatccataaacgataacgtagagaggctcatcaatctcacatcgtcggaatgtagtaaggatttgagggctcttaggatactcagtgagctacacgcaaagcggagtgattacaatgccagatcactgaacactcagaaggcagcagctggacaaaccaatagtgctcaacacttccagtctccagttgtaatcatgaagccggcgagaggtatcgtgaaaaagaatgcttcagttgctacccttgcagggacaaaagtccacagaaagttgcggcatgaagagagcactttcaccacgaagaccgacaacagtgacaggacgaagacccattctcacaatcaaagagctcattccaggcgagaggaagatgtgggcagcacaagttcaccaaagccttctagaattttgagcccaagacttgtgcggaagtcagactgtggaaggatcactcagctgacagttccactgatgtccccagccaagacatccaaagaagtatctccaagaggcaaactaagatcaagggcttcacaatcaaatagcatctgtggccatgataaagccatgattactgaaagcaaaatcagtttatcaaagcaggaaacacttatcctatgtactgacaagaacatccatccactggagaacataccgagtcctgtatcagtccttgatgccacattctatcaagatgtgatgtcgccttctctgaggggcatatcaaattctttcaaaaatgttgcgccacttacattacatgagtgctggaactcaataagcctccctgacacaccaacattgaagaaaagtaccgagagtaaccacataataccagaaaacatgaaagccctcatccaaaagctagagctcttgcaattgttgagtgacgaggctccaagaacaaatgacaattcgttaatactcactgccaataaagatcgtcattatatttatgaaatactctcagcatctggcctcttgcacaatgaactaaagttcaggataatgccctgcttgttccagcagccaagccacccaatcaatccagagctttttcttatccttgaacaagcaaaaccaactgcagggaagcttcaccgcaaactaatttttgatcttgcaattgaaatcattgctaagaaaatatacagtggcagttcagtgagacaaccattgcagttcattcaatgcaagaaatcaagcggatggcatcttttcaaggaattatgttcagagattgaaatgctccgatctgaggcctcagcaataagattatctgaagaggaagatgaagagagcaagctagcaaagaatgcaatacgtgaaatgggaaaatggaagagtttcggcagtgagctacaagggatagctctgggcattgaaagatccatctttaagaatctcattgacgaagtcataagtggtgaagacatgggaaaggtgtaa

SEQ ID NO: 52 - DNA, 4439 bp, Sorghum bicolor
ctcctcatcacatagctgagctgcccacgagcagagcaacattacactcctctcaaccgaaccgaatccaatccacccatagatcatgcaagcatactccgtacactctgctctgcacgcgctttctcttctgcctgccaacttcctcctggcctgagtaatacatcctagactagatagcctgtcaatggcgccaagtccgaggggatcaatccatacctcggctgcaaaaggagcttccttagctttccagagcacaagaactagccaaaaatgccgactagaatggcaaaggccttctcccatgaggccacggaatttggcggccagatggggtgcgtggccagcatgctccacatcttcgaccgccgccgccttctcaccggccgacgacatggtgactgccctggaaccaaggacgaggacgaactgcctccagcaggtacttcgactctgctactttttcattactactttgccatctgttccccccgactgaagaaagccatccatccttaccaaaaaaataaataaataatcaagaagccatcaggcgaccaactgaactgtacaaaaaaaagaaaagaaaaaagaactgtaccattataatagtgctgcaagtataagctgtagggtgacaaacaaaagtagtttaaaaatttatttcatgttcaacgtaatacaaggcaaaaacgactctttattgggaagaagatgaacaagaacaatgatcacccatggtatagtacaagctgcaggcatgcaacttcacttcacacatataagatagtgtcatgagaagttacatgggaatcaaaatgttcatgcaaaggaaattgatcttagaatcatttgtatttcagacatttcacttttcctccatcagttcaagttttccgaattacctgcaccacccctgcttgaagcataatatataactatacttttcgatattagttctaatacactgtgcttctgttgtccaggccatactctgccggttagcagcacgcatgccccggtgcaaagcacagctaatccaaacaacactgtggtaattttaaccacttcttttaacggcaaagaattcagatataattataactaaagccccagttggtcagccctgactctagattttgggttccttgaacaaactaattttaactcgattctaattacttgggcaggagaaatcgttcagcaaaagcaaaagcaaaagcatgactgagaacagtaccttctcaacagaatcatcgagagcatcttcagcatcgtcgtcctgctcttcattatcacccctggccaacagcaaaccagtacagcagaagctcccttgcatcaacgagaagcatgtcgtagcaaggagtaggacaatgaggagctcgcgaagctttaagtcttcagatacagaggtcaaatccatacagcaaaaaactgattttagagatgtcgtgaaggactccatcaaccaggactctcgtgtcctggccatcaagactaaaatgatggaacagagagatggactgcacaaagactcaccaaggccactgcttatatccaaatcaacagatggaacttatgtgattgctgttgataggagcaatgtgcctcctgcatatgtcaatgaatctagcaggcagcaacgtttatcatgtgatgatcgacagctgctgctgcaggtagaagctcaagacagcaagatgccttcatccaagcacatggagcttcctaggctgtccttggacagtaggaatgagtctgtcaagtcaagtttgcatcagaagaactttggttatgcaagaaccgatgacagtctcattgataatttgaaataccaagaatccccgagccatcggcgggccagtgctgtcgttgcaaagctcatgggattggaagagactctcgatgcccctgggtctgcaagatcacacagaccagaccgtcacactcgaaataattacctgccacacacctccaggagtatctgccatgacctcagtacattgcagccgaagattcagcctacaatactgaaaaccaaaccttctccgagaattgtccctgaagctgcagcttggaagcagcagaagataaatacagctagatattattctaaagaagggccaagttctacatccataaacgataacgtagagaggctcatcaatctcacatcgtcggaatgtagtaaggatttgagggctcttaggatactcagtgagctacacgcaaagcggagtgattacaatgccagatcactgaacactcagaaggcagcagctggacaaaccaatagtgctcaacacttccagtctccagttgtaatcatgaagccggcgagaggtatcgtgaaaaagaatgcttcagttgctacccttgcagggacaaaagtccacagaaagttgcggcatgaagagagcactttcaccacgaagaccgacaacagtgacaggacgaagacccattctcacaatcaaagagctcattccaggcgagaggaagatgtgggcagcacaagttcaccaaagccttctagaattttgagcccaagacttgtgcggaagtcagactgtggaaggatcactcagctgacagttccactgatgtccccagccaagacatccaaagaagtatctccaagaggcaaactaagatcaagggcttcacaatcaaatagcatctgtggccatgataaagccatgattactgaaagcaaaatcagtttatcaaagcaggtagatacgaacattattaattattcaaatactcttaatgtcaacacaacatccatccatcaaagcaatacaacttcaacatcgaattatgaggtacaaataaagattaatacatttccatgtcaaagaacctactattgattgagaattgtttcatcattcattatgtacatcagttagtgactactgaaagactttttttttcaggaaacacttatcctatgtactgacaagaacatccatccactggagaacataccgagtcctgtatcagtccttgatgccacattctatcaagatgtgatgtcgccttctctgaggggcatatcaaattctttcaaaagtgagaactttatctgtcaagcaattcttcacacgactctgagcactatccttgggttccaatcaatctaggaaaccatattgtttggtacatgacaagcatacttaactgtagtatgtcaaacaaacatgacaagcaactggtaatcaatgcaaccaaatgtagctcgttgtctagcaagctgggaagaaccacagtaaattggcagcgactgtagaaatgcaagtgcttgcttgtgccaaccagttaaagagcatcaattcttcactgccagtagtagttcatgtctgcacctaacatcttcatggagctcccacatgttacaattgcccatacagggatgtagatgagcccaaaagtataactgattttcttagttggattggttgcttttaggttgttctcggagcccccacatgcttgctgtattggtcgatctagctcttaatgctcaactaactttttctttctttacttgttcagatgttgcgccacttacattacatgagtgctggaactcaataagcctccctgacacaccaacattgaagaaaagtaccgagagtaaccacataataccagaaaacatgaaagccctcatccaaaagctagagctcttgcaattgttgagtgacgaggctccaagaacaaatgacaattcgttaatactcactgccaataaagatcgtcattatatttatgaaatactctcagcatctggcctcttgcacaatgaactaaagttcaggataatgccctgcttgttccagcagccaagccacccaatcaatccagagctttttcttatccttgaacaagcaaaaccaactgcagggaagcttcaccgcaaactaatttttgatcttgcaattgaaatcattgctaagaaaatatacagtggcagttcagtgagacaaccattgcagttcattcaatgcaagaaatcaagcggatggcatcttttcaaggaattatgttcagagattgaaatgctccgatctgaggcctcagcaataagattatctgaagaggaagatgaagagagcaagctagcaaagaatgcaatacgtgaaatgggaaaatggaagagtttcggcagtgagctacaagggatagctctgggcattgaaagatccatctttaagaatctcattgacgaagtcataagtggtgaagacatgggaaaggtgtaattttagcagtggaagtacaaaggggagttgtcttttgagaagcatatagactaaacaattttgttgttttcctgttttccatgaaactgacctgatggtagaagtaatgtatgtttagcagctgcaagaataactaggttgtacatatataaagtaaagtttcat

SEQ ID NO: 53 - protein, 876 aa, Sorghum bicolor
MPTRMAKAFSHEATEFGGQMGCVASMLHIFDRRRLLTGRRHGDCPGTKDEDELPPAGHTLPVSSTHAPVQSTANPNNTVEKSFSKSKSKSMTENSTFSTESSRASSASSSCSSLSPLANSKPVQQKLPCINEKHVVARSRTMRSSRSFKSSDTEVKSIQQKTDFRDVVKDSINQDSRVLAIKTKMMEQRDGLHKDSPRPLLISKSTDGTYVIAVDRSNVPPAYVNESSRQQRLSCDDRQLLLQVEAQDSKMPSSKHMELPRLSLDSRNESVKSSLHQKNFGYARTDDSLIDNLKYQESPSHRRASAVVAKLMGLEETLDAPGSARSHRPDRHTRNNYLPHTSRSICHDLSTLQPKIQPTILKTKPSPRIVPEAAAWKQQKINTARYYSKEGPSSTSINDNVERLINLTSSECSKDLRALRILSELHAKRSDYNARSLNTQKAAAGQTNSAQHFQSPVVIMKPARGIVKKNASVATLAGTKVHRKLRHEESTFTTKTDNSDRTKTHSHNQRAHSRREEDVGSTSSPKPSRILSPRLVRKSDCGRITQLTVPLMSPAKTSKEVSPRGKLRSRASQSNSICGHDKAMITESKISLSKQETLILCTDKNIHPLENIPSPVSVLDATFYQDVMSPSLRGISNSFKNVAPLTLHECWNSISLPDTPTLKKSTESNHIIPENMKALIQKLELLQLLSDEAPRTNDNSLILTANKDRHYIYEILSASGLLHNELKFRIMPCLFQQPSHPINPELFLILEQAKPTAGKLHRKLIFDLAIEIIAKKIYSGSSVRQPLQFIQCKKSSGWHLFKELCSEIEMLRSEASAIRLSEEEDEESKLAKNAIREMGKWKSFGSELQGIALGIERSIFKNLIDEVISGEDMGKV

SEQ ID NO: 54 - DNA, 2733 bp, Triticum urartu
atgacaggccgtactccaccagaaagcagcagcattgttccagtgcagagctcaagtacccccaaaatcattctggaaaaccaaggagaggacctgacctttcggtttattttgcaggagaaaacactcagcaaaagcatgaccgagaacagtagcctctcaatagagtcatcaagagcttcttgttcttcctcttcatgctcctctttctcgtcgatcgacggcagcaaatcagctcaacaggagctaccgtacatcaacgaagaactctttccgcagaggccaccgaagagctcaccaagtctgcagggcgctgacatggacaccaagaccgcacagccgaacgtcggtttcagagacatcgtcaaggactccatcaaccgggactcgggagggttaactgtcatgaccacagcgaatggagcaagaaggaacgcgcagtacaaggactcgccaaggccattgctgctctccaaatcgatggacggaacctacgtcatcagcatcgacaggaccaccaaggccgtccccgcaaacgtcgtcgagtccagcaggcgtttcccggagcagtcgcgcttctcatgcgacgaccggcggctcctgcggccggctgaaacccaagaagccaagaagccttcttccacaagggccaaagagcttcctaggctgtccttggacagcaggaaagagtctctgagcccaagttcacgtctgaagagctgcagttacaggagaaccgatgactctctcctggacactctgaagcctcaagactccccgggccacaggcgttccaacagtgtcatcgccaagctcatggggttggaagaagcaccagatgctatggggatgctggtcgctgatagctacgagcctgcaagatcaccaagaacagcagcacaagccacacggagcgagcgtccatcgcgttcgcccaggagagattgccaggatgcgtgtggttccctgccgaaaaacgagccttcagcactgaaaacaagacctcctccaagaattctcactgaagcggctccctggaggcagcaggagagaggcgtcagcgtcaccaacagcaaggcttcacaatgccgagacgctgaggtgaggccaagaaccccatctctctatgccgatatagagagaaggcttggtgggctcgagttctcggagtgcaacaaagacttcagagctctcagaattctgggtgtgttccatgcaaaggatgctaagcaccagaacaacgatggtgatgccgcatcagtggcttctcagagccaagaagaggattcagccaccaccagttccagaagcttccagtctcccattgtagtcatgaagtcatcaagaaccaccgagaagcctggggtctcagttgctccccttgcagggctgagaggcctcaggaagctgcagcccagagattcatccttcactgacaagagcgaagccagcacaaatgagaagatccattctcgcgttgcaagggctcaatccaagtctgacgaacctgccagcagagcgagctcgccaaggcctacagggtcatcaagccccaggttagtgcagaggaaggcagagtcggagaggcggtctcgtcccccggtctcaccaaagtctccaagcaagaagtcaaatgaagcagcatccccaagaggaagaacaagatcaaagccttctcaagtgaggagcaaccgtgacaatgaggcctcgcagagtccaggaagaaggatcagcttggcgaagcagattgacgtcagtataatggattgtcaaagtcctctggttgccagatcatcattcgtcgacccaaaaacaccgagccaaaagagcccttcttcaatcctgggttcagatcacaagatccattcactggagaacgccctgagccccgtgtcggtcctcgacacatccttctaccataaaagtatctcagattcattcaaagatggcgagacgcatacctcagacgaatgctggaattcaaacagcctgccggacacgccgcagtcgaagacgagcagtgaagtcagccagatcaaaccagaaaacctggaggcgctcattcagaaacttgaacaattgcaatcgatgaacgatgaagctgcaaactccaaagatcaccagtatatctacgagatactcttagcatctggtcttctgcacaaggaacttagcttcgcagcgatgcctgcacaactttcgccatccagctgcccgatcaatccagagctcttcctcattctagagcaaacaaagccgcacttcatttcagcgattcaggctgttaccggagctaagaagagttctgaccctaacatggagaagcttcatcgcagaattgtattcgatctggtaaatgaaattatagctcagaagatgaacatctatagctctgcaagtggaacggcgaaacttcttcggtcaaggaagttaagcgggtggcgtcttttcaaggaattgtgcacagaggtcgacaggctcttatccgagagctcggcagcgaaatgctccgaagaggatgaggatgaaaacataccattatctgaggatgcattgtatgagatgaaagattggggtagccctgaaggtgagctacaaggcatggttttggacattgaaagatccatcttccgggacctcattgacgaggtcataggttgcgaggctacagagaggatgcaagctggacaatggaaactgcgtaggcagctgtctttcagtagtataaactga

SEQ ID NO: 55 - DNA, 3729 bp, Triticum urartu
atgacaggttaacagctgagtatattttttcttctcatgttacaataatggtgaatagaaacaaaaaggcatcaccttttatcccatcacaaatccatccattttattattattaccatgataggatcataaagtgctctgttttctctgttttaaaatttagaccactattctaatgtcctttcatttttgtccaggccgtactccaccagaaagcagcagcattgttccagtgcagagctcaagtacccccaaaatcattctggtgattccccaatctggagtaaatcaacttaattttattggcaggaaaaccaaggagaggacctgacctttcggtttattttgcaggagaaaacactcagcaaaagcatgaccgagaacagtagcctctcaatagagtcatcaagagcttcttgttcttcctcttcatgctcctctttctcgtcgatcgacggcagcaaatcagctcaacaggagctaccgtacatcaacgaagaactctttccgcagaggccaccgaagagctcaccaagtctgcagggcgctgacatggacaccaagaccgcacagccgaacgtcggtttcagagacatcgtcaaggactccatcaaccgggactcgggagggttaactgtcatgaccacagcgaatggagcaagaaggaacgcgcagtacaaggactcgccaaggccattgctgctctccaaatcgatggacggaacctacgtcatcagcatcgacaggaccaccaaggccgtccccgcaaacgtcgtcgagtccagcaggcgtttcccggagcagtcgcgcttctcatgcgacgaccggcggctcctgcggccggctgaaacccaagaagccaagaagccttcttccacaagggccaaagagcttcctaggctgtccttggacagcaggaaagagtctctgagcccaagttcacgtctgaagagctgcagttacaggagaaccgatgactctctcctggacactctgaagcctcaagactccccgggccacaggcgttccaacagtgtcatcgccaagctcatggggttggaagaagcaccagatgctatggggatgctggtcgctgatagctacgagcctgcaagatcaccaagaacagcagcacaagccacacggagcgagcgtccatcgcgttcgcccaggagagattgccaggatgcgtgtggttccctgccgaaaaacgagccttcagcactgaaaacaagacctcctccaagaattctcactgaagcggctccctggaggcagcaggagagaggcgtcagcgtcaccaacagcaaggcttcacaatgccgagacgctgaggtgaggccaagaaccccatctctctatgccgatatagagagaaggcttggtgggctcgagttctcggagtgcaacaaagacttcagagctctcagaattctgggtgtgttccatgcaaaggatgctaagcaccagaacaacgatggtgatgccgcatcagtggcttctcagagccaagaagaggattcagccaccaccagttccagaagcttccagtctcccattgtagtcatgaagtcatcaagaaccaccgagaagcctggggtctcagttgctccccttgcagggctgagaggcctcaggaagctgcagcccagagattcatccttcactgacaagagcgaagccagcacaaatgagaagatccattctcgcgttgcaagggctcaatccaagtctgacgaacctgccagcagagcgagctcgccaaggcctacagggtcatcaagccccaggttagtgcagaggaaggcagagtcggagaggcggtctcgtcccccggtctcaccaaagtctccaagcaagaagtcaaatgaagcagcatccccaagaggaagaacaagatcaaagccttctcaagtgaggagcaaccgtgacaatgaggcctcgcagagtccaggaagaaggatcagcttggcgaagcagattgacgtcagtataatggattgtcaaagtcctctggttgccagatcatcattcgtcgacccaaaaacaccgagccaaaaggtacagataaatagatatataatcatatagtatgaaagaaaccagccagctctaagtatttttttcttcatatgctcattgttaacactaactaacggaacttctcattttcttcagagcccttcttcaatcctgggttcagatcacaagatccattcactggagaacgccctgagccccgtgtcggtcctcgacacatccttctaccataaaagtatctcagattcattcaaaggtgagaagttgatctagcatttttcctgcatattcatttgcaatgacatataatagataaaccaccaatttgttagtaataatcgatagccaccagctgtaagatcaatggcataataggtcctactatttggtcccattcaattcagaagcacacagtgctatgcaaaggacaaacatagttagctgtaagcataccaatgccgctagtgacagataatctgcatttaaggctaccagaggcagctcgtggtcctgcgagtgggagtgggagggggaggaaccacatcatattgatagttgcatctgatgtgctggtgctgaacagtgctattttcgcaagccccacatgttgcactcgctcatgcagcagcatgatgcatgtcctctggtgtctatgcattgctagtgtagatgtgcccaccagtgtcccctttatagatgcacctagtgtgtgtggttcagtgaatcatgtagacagagcagtacagtgaattcatatctccagtctgatccatgtacatgtctgtttcagtttaactgtctgtagcagattcagtatttctgtctggtacattatttttttctgtggttgtgtcaagcattggttccttaatatgtgtacatcctttttctgattgttcagatggcgagacgcatacctcagacgaatgctggaattcaaacagcctgccggacacgccgcagtcgaagacgagcagtgaagtcagccagatcaaaccagaaaacctggaggcgctcattcagaaacttgaacaattgcaatcgatgaacgatgaagctgcaaactccaaagatcaccagtatatctacgagatactcttagcatctggtcttctgcacaaggaacttagcttcgcagcgatgcctgcacaactttcgccatccagctgcccgatcaatccagagctcttcctcattctagagcaaacaaagccgcacttcatttcagcgattcaggctgttaccggagctaagaagagttctgaccctaacatggagaagcttcatcgcagaattgtattcgatctggtaaatgaaattatagctcagaagatgaacatctatagctctgcaagtggaacggcgaaacttcttcggtcaaggaagttaagcgggtggcgtcttttcaaggaattgtgcacagaggtcgacaggctcttatccgagagctcggcagcgaaatgctccgaagaggatgaggatgaaaacataccattatctgaggatgcattgtatgagatgaaagattggggtagccctgaaggtgagctacaaggcatggttttggacattgaaagatccatcttccgggacctcattgacgaggtcataggttgcgaggctacagagaggatgcaagctggacaatggaaactgcgtaggcagctgtctttcagtagtataaactga

SEQ ID NO: 56 - protein, 910 aa, Triticum urartu
MTGRTPPESSSIVPVQSSSTPKIILENQGEDLTFRFILQEKTLSKSMTENSSLSIESSRASCSSSSCSSFSSIDGSKSAQQELPYINEELFPQRPPKSSPSLQGADMDTKTAQPNVGFRDIVKDSINRDSGGLTVMTTANGARRNAQYKDSPRPLLLSKSMDGTYVISIDRTTKAVPANVVESSRRFPEQSRFSCDDRRLLRPAETQEAKKPSSTRAKELPRLSLDSRKESLSPSSRLKSCSYRRTDDSLLDTLKPQDSPGHRRSNSVIAKLMGLEEAPDAMGMLVADSYEPARSPRTAAQATRSERPSRSPRRDCQDACGSLPKNEPSALKTRPPPRILTEAAPWRQQERGVSVTNSKASQCRDAEVRPRTPSLYADIERRLGGLEFSECNKDFRALRILGVFHAKDAKHQNNDGDAASVASQSQEEDSATTSSRSFQSPIVVMKSSRTTEKPGVSVAPLAGLRGLRKLQPRDSSFTDKSEASTNEKIHSRVARAQSKSDEPASRASSPRPTGSSSPRLVQRKAESERRSRPPVSPKSPSKKSNEAASPRGRTRSKPSQVRSNRDNEASQSPGRRISLAKQIDVSIMDCQSPLVARSSFVDPKTPSQKSPSSILGSDHKIHSLENALSPVSVLDTSFYHKSISDSFKDGETHTSDECWNSNSLPDTPQSKTSSEVSQIKPENLEALIQKLEQLQSMNDEAANSKDHQYIYEILLASGLLHKELSFAAMPAQLSPSSCPINPELFLILEQTKPHFISAIQAVTGAKKSSDPNMEKLHRRIVFDLVNEIIAQKMNIYSSASGTAKLLRSRKLSGWRLFKELCTEVDRLLSESSAAKCSEEDEDENIPLSEDALYEMKDWGSPEGELQGMVLDIERSIFRDLIDEVIGCEATERMQAGQWKLRRQLSFSSIN

SEQ ID NO: 57 - DNA, 3120 bp, Zea mays
atgggccttgcgatgcagcgggagcatcaggaccagggaggacacacacaccacgccgaaccgctactcccccgcctctgcctcagctctgaccgttcactgccgtgccccctcctgcccgccacggaaccttctacgcctccggaggaggactctcccgtcggtggcgccgccgcgccggccacaccggtcgtcgcgcctgaatgctgcgatcgtcctgcaggccgcactacgcctgaccgggccgacagccagctcgcgaagatgcacgccgggacgacgcgcggcgacggcggcacgcggggcctccagcgccgattcggctgcatggccggcattttccagatcttcgaccgccatcggctcatcgccggggccggccgccgcgccgcccggcaggcgcagaagaggctgcctccgccttcttccgctccgccaggcaaaactcaacatccaaagagcagcagcgatgttctagttcaaagttcaagtgcgtcgaagatcgttctggagaaaacattgagcaaatgcacgaccgagaacagcagcctttccatcgaatcgtcaagcgattcgtcttcctcctctccgtgcacgtccttctcctccctcgatggcaacaaatcagtccaacaggagcttccttacaccagcgaggagctctttgcgcagaggccactgaagagctcgccgagtctgagggaacctgacatgaacgccaagtctggccatcctaatgccggtttcagagacatagtgaaggactgcatcaaccgggactccggaggcctgacggtaaaaacttcggtgcacgaggcaaggagaaatgggcagcacaaggactcaccgaggccactgctgctgtccaaatcaatggatgggacctgtatcattgggatcgataggaccacaaatgttcctgcaaatgtcaatggatctagaaggtgtttgcaggagcagtcacgcttttcttgtgatgaccgaaggctcctgcgaccaactgaaacccaggaaagcaagaggtcttcctcgaggccaaaggagcttcctagattgtccttggacagtaggaaggagtctctgagtccaggctcacgtcagaaggacctcggttacaagagaactgatgatattcttctggatactttgaggcctcaagattcccctagccatagcagagctaacagtgtcattgccaagctaatggggttggaagaagcaacaaatgctacaggagtgctcactgccgatagctgtgaacccacaaggtcaccgagaccagctcagaccactcaatatgggcatccatcacgctcccccagaggcacttgccaggattcctgcagcatgcagctgaagaacgagtcctcagtactgaaaaccaagccttccccacgaattctcacagaagcagctccttggagacagcaggaaagaagtgtcaccaatatctgtcgagaagctgaagggaggccaaggattgcatctgtctatgctgatatagagagaagggttgggggcttcgactttttagagtgtaataacaaggacttcagggctctcagaatattgggtgcattgaatgtgagagatgctaagaacaagaatgacagcagtggcagaccaatggctactcacagaacaggatatgacctaaccacctctggaagcttccaggctcctattgtggtcatgaagcctgcaggaaccactgagaagcatggggtttcacttgcttctgttgcccccatagcaggcctcagaagcctcagaaagttgccagctagatattcatctttcactggcacaaatgaggccagcacaaatgagaatattcatcttcagatgtcaagagctcaattgaagtctgaagaaactgtcagcagtgccagctcaccaaggcctacaagctcatcgaaccccagaaatgtgctaaagaaggcagaacctgaaagaagatcccgtccacctgtttcaccaaaatctccaagcaagaagtccaatgaagctgtctccccaaaaggaagaacaagatcaaagccttctcaggtgaaaagccaccgtgatgaggtcttgcatagtacagggaacagaataagcttagctaagcaggttgacgtcagcgttatagattgtccaaagcctccgggtggcaactcaaccttcgttccaccaagcaatgctgctgcaacagcaagtcacaaggctccttcaattctggattcagaccaaaacattcattcactggacaacattccaagccctgtctctgtccttgatacatccttctatcataaaaggatctcagattcattcaaagatggtgagacacattcttcagaggaatgctggaacccaaacagcctgcctgacacaccacagtcaaaagcgagcagtgaagccaaccagattaaaccagaaaatttggaagttctgatccagaagcttgagcagctacagtcaatgaacgaagaagacgcaagtatcaaagaagtcatggcatcagtcactgcaaataaagatcaccagtatatctatgagatactgttggcatctggtcttttgcacaaagaacatagtatcacggcattacctgctcaactccaaacatcaaattatccaatcaatccggagctcttcctcattcttgagcaaacaaaaccagacttagttttcgcattccaagctgtcagtggaactaagaaaacttgtaagccttacacagggaagcttcaccgaagacttgtgtttgacctggtaaacgaaacaatagctcaaaagatgatcatctgcagatctggaagccagccagcaaagtttcttcaatcaaggaagttgagtgggtggcaactattcaaggatttgtgcactgaggttgacaggcaaataaaatgcaccggggaggaggagaatggaaacatgatattagatgaggatacagtcaatggaacgaaagactggatgagcttcgacactatgctacatggcatagtttgggagattgaacgatccatcttcaagggtcttatcgacgaggttatcggcggtgagactatagagaagatgcaatttgggcaaaggaaactgcagaggcagctttctttcagtagtataaactga

SEQ ID NO: 58 - DNA, 5684 bp, Zea mays
gccatcacacatgcacacccaaacccacacccacatgccagcccgccaagagcgaactgcttccccacctccccacgacgggagcctgcatggccatgacgcccgcaatgataataataacatccctctgaactcgcccgcgcccatcccaaaaccgaacacacagcacaagagaactctgctccgctccgccttccactgcattccgtagtacgtacctacctacctcctgtgcccgcgcgcagaaccgctactcccccgcctctgcctcagctctgaccgttcactgccgtgccccctcctgcccgccacggaaccttctacgcctccggaggaggactctcccgtcggtggcgccgccgcgccggccacaccggtcgtcgcgcctgaatgctgcgatcgtcctgcaggccgcactacgcctgaccgggccgacagccagctcgcgaagatgcacgccgggacgacgcgcggcgacggcggcacgcggggcctccagcgccgattcggctgcatggccggcattttccagatcttcgaccgccatcggctcatcgccggggccggccgccgcgccgcccggcaggcgcagaagaggctgcctccgccttcttccgctccgccaggtaactaatggcttctcccctcgcgccgtgctttcgctgcgccctgcgcgcgtctctcagctgttatgttcgcgtccgtcactcttggctcaagtatttccgagcaaaccaccttgtttctttatttacccacgcccttcttctttttaactccgtcactaattgcacgtctttgcttctaagaacgcatccggttcctaatgacgcgccttctctaagttgttactagatacgctcgtcctggtatgttgactagagatatgagaaagctaggtgtttttctttttcattttttttacttaacataaaacaaaaacatcgcttccaaatctgatactgctaccttgtagttgatagcaagccctttcatactgctactcaaagtttggtaagatctgacagttggaaacttggaaggttcggcggcaaagaccaacctatcaaaggctcaaagcatttcaaaaaaaaaacccttggttggtaaaactgcctgtacaaacacaagtataaaaacccggttggcttgcagcgtgggcgagccacgttctgtagggtggaacctgcaaaaaggaaattgccatgttggtactgacaaagaggctcggaggtttgctgtgcaagttacattacgtgctgtgactgtgaggaaaaccatgtgtgtactatagagcagcggttgactctagcaattgtgaccatccataagagcgtttacttaagaatgcactaataaaacgacagcacacatacctttttagcagtagatgagcgcggggcatcggcgcaacggcatccaatgatgagggttcgggtacccggagccggaaatagaatgaggaaaactgttttcgctgactgaggaggacagctcaacagtacagtgtaatttcatctatgtaatcgaactgaataggacatcttaacattttgtatatattttttttaaaggagagacccttctaccaatgccatattaactgaagaggacagcttaccatttactacctttttaaaaacaaatccttctaatgacatattaactgaagaggacagcttaacatttagtagttttttttaaaataaataaataaataaataattcttctaccaatgacagattaaccgaaaatggtagcacagcaatttgattgtagctcgattttctctgcttagatattttactctaaaataataacaatgcctccgtatgttttccaggcaaaactcaacatccaaagagcagcagcgatgttctagttcaaagttcaagtgcgtcgaagatcgttctggtaatattctctactagattgactcaacctattctctctctctctctctctctctctctctctctctctctctctctctctctctctctccggacaggaaactattttactcatgcaacagaattctggaattatgttagaaatgacgtaaacaagttgacactgacctctctgtcgttttttgcaggagaaaacattgagcaaatgcacgaccgagaacagcagcctttccatcgaatcgtcaagcgattcgtcttcctcctctccgtgcacgtccttctcctccctcgatggcaacaaatcagtccaacaggagcttccttacaccagcgaggagctctttgcgcagaggccactgaagagctcgccgagtctgagggaacctgacatgaacgccaagtctggccatcctaatgccggtttcagagacatagtgaaggactgcatcaaccgggactccggaggcctgacggtaaaaacttcggtgcacgaggcaaggagaaatgggcagcacaaggactcaccgaggccactgctgctgtccaaatcaatggatgggacctgtatcattgggatcgataggaccacaaatgttcctgcaaatgtcaatggatctagaaggtgtttgcaggagcagtcacgcttttcttgtgatgaccgaaggctcctgcgaccaactgaaacccaggaaagcaagaggtcttcctcgaggccaaaggagcttcctagattgtccttggacagtaggaaggagtctctgagtccaggctcacgtcagaaggacctcggttacaagagaactgatgatattcttctggatactttgaggcctcaagattcccctagccatagcagagctaacagtgtcattgccaagctaatggggttggaagaagcaacaaatgctacaggagtgctcactgccgatagctgtgaacccacaaggtcaccgagaccagctcagaccactcaatatgggcatccatcacgctcccccagaggcacttgccaggattcctgcagcatgcagctgaagaacgagtcctcagtactgaaaaccaagccttccccacgaattctcacagaagcagctccttggagacagcaggaaagaagtgtcaccaatatctgtcgagaagctgaagggaggccaaggattgcatctgtctatgctgatatagagagaagggttgggggcttcgactttttagagtgtaataacaaggacttcagggctctcagaatattgggtgcattgaatgtgagagatgctaagaacaagaatgacagcagtggcagaccaatggctactcacagaacaggatatgacctaaccacctctggaagcttccaggctcctattgtggtcatgaagcctgcaggaaccactgagaagcatggggtttcacttgcttctgttgcccccatagcaggcctcagaagcctcagaaagttgccagctagatattcatctttcactggcacaaatgaggccagcacaaatgagaatattcatcttcagatgtcaagagctcaattgaagtctgaagaaactgtcagcagtgccagctcaccaaggcctacaagctcatcgaaccccagaaatgtgctaaagaaggcagaacctgaaagaagatcccgtccacctgtttcaccaaaatctccaagcaagaagtccaatgaagctgtctccccaaaaggaagaacaagatcaaagccttctcaggtgaaaagccaccgtgatgaggtcttgcatagtacagggaacagaataagcttagctaagcaggttgacgtcagcgttatagattgtccaaagcctccgggtggcaactcaaccttcgttccaccaagcaatgctgctgcaacagcaagtcacaaggtacagataaaacggaaagaaagttcataccagtaatccacctaattctacaatttccatgcatcatgtattcattgtttaccactactttactaatgagtggttcctctctatcctctttcaggctccttcaattctggattcagaccaaaacattcattcactggacaacattccaagccctgtctctgtccttgatacatccttctatcataaaaggatctcagattcattcaaaggtgagaaattattttcttagttaccagtaataatttgcattagatatccgcttgtttcatgcaataacattagcatgatagatcctttggcttggtcttatttaattcagaaacccatagtgttattaaaagtacaagcatagctagctgtcagcgtgctgacaacgctggtgacagataatctgcaataaaagctaccaggtagctcgtggtccttcagttaggacgaacagttcatggctgcaaccccacatgcagcaatgcttatgcaggagcatgatatgtgtcttttggtgtgcccacaaatatccccttatacgaacacacccagtgtgtatgatctgtatatttatatctagttagacaatgtttttctctctcctgtatgatacgtgttttctttagttgaattgtctggcagcgaactccgtatttttgtttggtacaacaattggttctgagctgtataggaattgttttctgaacatacccttttacttgttcagatggtgagacacattcttcagaggaatgctggaacccaaacagcctgcctgacacaccacagtcaaaagcgagcagtgaagccaaccagattaaaccagaaaatttggaagttctgatccagaagcttgagcagctacagtcaatgaacgaagaagacgcaagtatcaaagaagtcatggcatcagtcactgcaaataaagatcaccagtatatctatgagatactgttggcatctggtcttttgcacaaagaacatagtatcacggcattacctgctcaactccaaacatcaaattatccaatcaatccggagctcttcctcattcttgagcaaacaaaaccagacttagttttcgcattccaagctgtcagtggaactaagaaaacttgtaagccttacacagggaagcttcaccgaagacttgtgtttgacctggtaaacgaaacaatagctcaaaagatgatcatctgcagatctggaagccagccagcaaagtttcttcaatcaaggaagttgagtgggtggcaactattcaaggatttgtgcactgaggttgacaggcaaataaaatgcaccggggaggaggagaatggaaacatgatattagatgaggatacagtcaatggaacgaaagactggatgagcttcgacactatgctacatggcatagtttgggagattgaacgatccatcttcaagggtcttatcgacgaggttatcggcggtgagactatagagaagatgcaatttgggcaaaggaaactgcagaggcagctttctttcagtagtataaactgaatatgcgtcgtagcagtcatttccatggaagcttataacaactagtaaatgtgacagtttctattttttctgaagactaaactgtacaagtataaatgatcctcaacactagtcttgctgcctgactattgcaattcgagatttgtgtgacatgactactgtttgactctactaccggtcaaggcgattgaagtgcacagtaccccgcgtgtgcatggtggacccattatatcaagtgtttataggaatgtcgggtagatgataacttgagataaagttctcgttttttgcatttattgttacggatgatgttgcggtcaaactgtatgccgcaaatgtacc

SEQ ID NO: 59 - protein, 1039 aa, Zea mays
MGLAMQREHQDQGGHTHHAEPLLPRLCLSSDRSLPCPLLPATEPSTPPEEDSPVGGAAAPATPVVAPECCDRPAGRTTPDRADSQLAKMHAGTTRGDGGTRGLQRRFGCMAGIFQIFDRHRLIAGAGRRAARQAQKRLPPPSSAPPGKTQHPKSSSDVLVQSSSASKIVLEKTLSKCTTENSSLSIESSSDSSSSSPCTSFSSLDGNKSVQQELPYTSEELFAQRPLKSSPSLREPDMNAKSGHPNAGFRDIVKDCINRDSGGLTVKTSVHEARRNGQHKDSPRPLLLSKSMDGTCIIGIDRTTNVPANVNGSRRCLQEQSRFSCDDRRLLRPTETQESKRSSSRPKELPRLSLDSRKESLSPGSRQKDLGYKRTDDILLDTLRPQDSPSHSRANSVIAKLMGLEEATNATGVLTADSCEPTRSPRPAQTTQYGHPSRSPRGTCQDSCSMQLKNESSVLKTKPSPRILTEAAPWRQQERSVTNICREAEGRPRIASVYADIERRVGGFDFLECNNKDFRALRILGALNVRDAKNKNDSSGRPMATHRTGYDLTTSGSFQAPIVVMKPAGTTEKHGVSLASVAPIAGLRSLRKLPARYSSFTGTNEASTNENIHLQMSRAQLKSEETVSSASSPRPTSSSNPRNVLKKAEPERRSRPPVSPKSPSKKSNEAVSPKGRTRSKPSQVKSHRDEVLHSTGNRISLAKQVDVSVIDCPKPPGGNSTFVPPSNAAATASHKAPSILDSDQNIHSLDNIPSPVSVLDTSFYHKRISDSFKDGETHSSEECWNPNSLPDTPQSKASSEANQIKPENLEVLIQKLEQLQSMNEEDASIKEVMASVTANKDHQYIYEILLASGLLHKEHSITALPAQLQTSNYPINPELFLILEQTKPDLVFAFQAVSGTKKTCKPYTGKLHRRLVFDLVNETIAQKMIICRSGSQPAKFLQSRKLSGWQLFKDLCTEVDRQIKCTGEEENGNMILDEDTVNGTKDWMSFDTMLHGIVWEIERSIFKGLIDEVIGGETIEKMQFGQRKLQRQLSFSSIN

SEQ ID NO: 60 - DNA, 504 bp, Glycine max
atggctcgaaagaagaaactagaaatggatggtggtggctacaacttaacaacaacctctttgagcagttcaatggagcaagtgatgagacccaaatcaccattgccgggcttagttgattttcatgggaagcggaagcaaatggttaagattcaggttttggagagagagattggtttgcttcaggaggaattaaaatcacttgaaggccttaaccctgcttctagatgctgcaaagagcttgatgcctttgtagactctgtttcagatcccttcacacccacaagaaaacagacagtctctaaatcccatcacttcaggaggcagatgatcagtcttccacgggtttgctgctccaacagttgcctgctgcataagaaaacagcaaaaggttgttgttgggactgctgttcttcatcaaactccaagtgttgtcactgttgtggctgctgctgctgctgcttgaagagtgcatcaagatcctgtgctcaaaattgttgctag

SEQ ID NO: 61 - DNA, 832 bp, Glycine max
ttgactacacaaacccgcttgtggaccaatcaactttcggtgcacgttacattgcctccgcgcaaactgctatcctgcgctgtgctgggaagacaacctctttcatggctcgaaagaagaaactagaaatggatggtggtggctacaacttaacaacaacctctttgagcagttcaatggagcaagtgatgagacccaaatcaccattgccgggcttagttgattttcatgggaagcggaagcaaatggttaagattcaggttttggagagagagattggtttgcttcaggaggaattaaaatcacttgaaggccttaaccctgcttctagatgctgcaaagagcttgatgcctttgtagactctgtttcagatcccttcacacccacaagaaaacagacagtctctaaatcccatcacttcaggaggcagatgatcagtcttccacgggtttgctgctccaacagttgcctgctgcataagaaaacagcaaaaggttgttgttgggactgctgttcttcatcaaactccaagtgttgtcactgttgtggctgctgctgctgctgcttgaagagtgcatcaagatcctgtgctcaaaattgttgctagagtgtgctttttcctgtgaaccctcgttctcattgtgtgaagaactgttgtcgtacacacgttatcaataactaaagaactatcataaagctcaagtgaaaaacatagtttataagggaatgatggcaatatccatcatcattttccttcttagctaacaaatggtcttgggttgcatttgataaaaatcaacaagtgttctgtgactgagaattagaaaagaa

SEQ ID NO: 62 - protein, 167 aa, Glycine max
MARKKKLEMDGGGYNLTTTSLSSSMEQVMRPKSPLPGLVDFHGKRKQMVKIQVLEREIGLLQEELKSLEGLNPASRCCKELDAFVDSVSDPFTPTRKQTVSKSHHFRRQMISLPRVCCSNSCLLHKKTAKGCCWDCCSSSNSKCCHCCGCCCCCLKSASRSCAQNCC

SEQ ID NO: 63 - DNA, 774 bp, Camelina sativa
atgtctgctccttctggcggtggtggaggaggaggaggagctggccatggtggtgctggtggtgaagtgggttcgtctccttttgctccttcgtcactaccgccgcctcgtcctaagtctccgccggagtatccagatttgtacgggaaacgcagagaggcggcgagagttcagatgctcgagagagagattggttttctcgagggggaaattaaattcgtagaaggagtacaaccagcttctagatgctgcaaagaggtctctgattttgtagttgcaaattctgacccaatgatccctgcacaacgaaaaagtcgaagatcctgccgcttctggaagtggctctgtggcccgtgttttagcatggtgagtttctgctgttgctgccaatccaagtgttcgtgccatctgaagaagcccaagtgctgtagctgtacatcttgcagctgcattgggtccaaatgctgtgacggatcgtgctcctcaagcatttgttgttgcccaagaccaagctgcccaggttgtccaagctgttcatgcttccgaggttgctgttgttcttgtccggacttgtcttgctgcattcccaaatgtttccgcagttgcagttgcgcccgaccgtcgtgtctgagtaaaaagaagagttcatgctgcaactgcaactgcaagatcagatggtcatcttgttttagatgtcccaaggtacgactttgttcttgttgtttttgcaattgtaaaaatctatgttctaatccctgttgtttagctttctaa

SEQ ID NO: 64 - DNA, 2905 bp, Camelina sativa
aaaaaaacatatcccatgggaggctcgcttagtaatcatcacttacaaaaagacaaaattattcacaagtttattacaaaaatcaagaaagagtttcttcctttaagagataaagaagaaatgaaccaaaaaatatgacttatagagaaaataactataatgatgccaacaaaaagaaaaataagaagagaaaatagctataataataataataatgtttagaaagctaaacaacagggattagaacatagatttttacaattgcaaaaacaacaagaacaaagtcgtaccttgggacatctaaaacaagatgaccatctgatcttgcagttgcagttgcagcatgaactcttctttttactcagacacgacggtcgggcgcaactgcaactgcggaaacatttgggaatgcagcaagacaagtccggacaagaacaacagcaacctcggaagcatgaacagcttggacaacctgggcagcttggtcttgggcaacaacaaatgcttgaggagcacgatccgtcacagcatttggacccaatgcagctgcaagatgtacagctacagcacttgggcttcttcagatggcacgaacacttggattggcagcaacagcagaaactcaccatgctaaaacacgggccactgcatcgagttattagttaatcagatcacattgttaggacaagatttactcatttgtcattctatccatctaagatcaagcattaccaaaaaacagttcttactatttgatgccttattcagattttatataagatgttgaaaatataatatttctaaacttaaagcaccctaaaattcttaccagagccacttccagaagcggcaggatcttcgactttttcgttgtctgtccgtatgagaaaaaaaaaaacaacacaacggaattgtaagagcaggcaaagtaagagaaaagtgaagtcactgagtgaactagaaatataacgcttacgcagggatcattgggtcagaatttgcaactacaaaatcagagaccctgccacaataaaaacatttttatttatcaaataaaccaaaccgtaataaaaactgatacaatgtttgaaaaaacagagaggtcatctcactctttgcagcatctagaagctggttgtactccttctacgaatttaatttccccctgctccatgaggtcattcgaaatattaattaagaaattaacttcattcattaatcaactaacccaaagctaattgttactatttgcttgtgaaatatgagaaaagctgattacacaagaagacactgatgggacaaacacacaagagaaactaaaacatagtgtaacaaaaacttatttaatttcccaaaaatatgccattatagagagtaaaacataaggtaacggggaaagcaacgtgaagaaaaaggtgaacaagaattgggtcctttcaaacgcagatagcaaataaagacaaaaactttcacaaaaattgattgatatggaaaagcaaaacaaaacaaaatcgaagctaaccaaattcattatatatttttaaagatctatactcagctttccctactttggctctcttctaatgccctctctttttttcttttcttctttttctttatcattttcctttaaatactctctttgactaagcactcactttcatagtacacatgcacgaacacattacgcctctcactgatgcaaacagcaacagagtaaatgggcgtcttatcaatcacttgacaccacacgatgatcacattttttttttaacttttaacatttacatttacatttacttttgacaatatttgataacaaaacaaatcctgattaaatgaggattagaatagaagttagttgaaaaagcttaggaacttaattagtttagttttgtaatcaatagatccgttgagactccctcaactaacacaagttttaaatgattcaaattaattaaacgacaaaaacaaaaagaaaatgattcaaattaatgttcaatttaaaaacatgcatatactagtatcatgtggagtagtacgagtttgaaattaattagatataaatgtgtctgatgacagaaattaaattactctttttgagagcatctaagagaataaagaaaaaattaaatgtcttggtttctactttctataattgctgtcaaacataacacaatggtccagaatccaaaccaacctggatatagtaggaaccaagtttttatttaacaaaatcgataccctcttttctcacaacaacaaaataaataaaaatcaaattgtgtacttagattacttacacaagaaaagttttactaaaaaataattcatattctaataaaaaaccaacactagtatcaaactatcaattagtataaaaagagactaataaaaaacaaaatgagtaatgaaattcaaaatattcggacacttcctcagagtaatcaaaatgacagattaaacaaataatagtatatgaaaaggactgtttttttaaaataaaaatataataataataataattttaagtactttttttttctaatttaaagaacttgcctcgagaaaaccaatctctctctcgagcatctgaactctcgccgcctctctgcgtttcccgtacaaatctggatactccggcggagacttaggacgaggcggcggtagtgacgaaggagcaaaaggagacgaacccacttcaccaccagcaccaccatggccagctcctcctcctcctccaccaccgccagaaggagcagacattttgagagagaagtggtttgtttgagagtcttaagatagaaacatgcagtattgtaacttaagagaaaagtgaacaaaaaagtgtcaagaggaagaaagaagaagaagcggcgagtgagtgagtgagtgagaaaaacaa

SEQ ID NO: 65 - protein, 257 aa, Camelina sativa
MSAPSGGGGGGGGAGHGGAGGEVGSSPFAPSSLPPPRPKSPPEYPDLYGKRREAARVQMLEREIGFLEGEIKFVEGVQPASRCCKEVSDFVVANSDPMIPAQRKSRRSCRFWKWLCGPCFSMVSFCCCCQSKCSCHLKKPKCCSCTSCSCIGSKCCDGSCSSSICCCPRPSCPGCPSCSCFRGCCCSCPDLSCCIPKCFRSCSCARPSCLSKKKSSCCNCNCKIRWSSCFRCPKVRLCSCCFCNCKNLCSNPCCLAF

SEQ ID NO: 66 - DNA, 748 bp, Arabidopsis thaliana
atgtctgctccttctggcggtggcgaaggaggaggaaaagaatcagctgctggtggagtgagttcatcgtctcttgctccgtcgtctctaccaccgcctcgtcctaagtctccaccagagtatccagatttgtacgggaaacgcagagaggcggcgagagttcagatgctcgagagagagattggttttctcgagggcgaaattaaattcatcgaaggcgtacaaccggcatctagatgcatcaaagaagtctctgattttgttgttgcaaattctgacccattgatccctgcacaacgaaaaagtcgaagatccttccggttctggaagtggctctgtggcccatgtttgagcctggtgagtttctgctgttgctgccaatccaaatgttcgtgccatctgaggaaacccaagtgctgcaactgtacatcttgcagctgtatagggtccaaatgctgtgacgggtcatgctgctcaaacatttgttgttgcccgagactaagctgcccgagctgttcatgcttccgaggttgctggtgttcttgtccggacatgtcttgctgcattcccagctgtttccgcagttgcagttgcactcgaccgtcgtgtctgaataaaaagaagagctcatgctgcagctgcaactgcaagatcagatggtcatcttgttttagttgtcccaaggtacgactttgttcttgttgtttttgcaattgtaaaaatctatgttctaatccttgttgtttag

SEQ ID NO: 67 - DNA, 2723 bp, Arabidopsis thaliana
acaaaatcaagaaagtgttgcttcctttaagagattaagaaaaaatttgaacaaaaaatagaggaaacagctataatgattataataataataaagtttaattagaaagctaaacaacaaggattagaacatagatttttacaattgcaaaaacaacaagaacaaagtcgtaccttgggacaactaaaacaagatgaccatctgatcttgcagttgcagctgcagcatgagctcttctttttattcagacacgacggtcgagtgcaactgcaactgcggaaacagctgggaatgcagcaagacatgtccggacaagaacaccagcaacctcggaagcatgaacagctcgggcagcttagtctcgggcaacaacaaatgtttgagcagcatgacccgtcacagcatttggaccctatacagctgcaagatgtacagttgcagcacttgggtttcctcagatggcacgaacatttggattggcagcaacagcagaaactcaccaggctcaaacatgggccactgcattgagttaattaattagtatcactttattcagatagctacacatatcagtaattctagcaaaatctaagattaaaagcattggctaaaaacatttcttactagttgaggtcttatgcaaattttatataaaattgcgaaaataaaatattttcaaaatataatgttccaatttaaatgcttaccagagccacttccagaaccggaaggatcttcgactttttcgttgtctatttatatgagaagacaaaaacagcacaacggaattgtaagagcgggcaaagtacgagaaaagtgtgaagtcattgagtgaactagaaatacgcttacgcagggatcaatgggtcagaatttgcaacaacaaaatcagagactctgccacaacaaaatatttcttttatcaataaaccaaactgataaaaactgatagaatgtttttaaaacactcactctttgatgcatctagatgccggttgtacgccttcgatgaatttaatttcgccctgatcataacgacattcgaaatattggttaagaaacatcatttcattaatcaaccaaattgtatttgcttggttaaaaaaagagaagatctaaattaagtagacactaatgggacaaaacaagaattgcatattaaactaaacatatacagtgtaaaaaataatttaattacaaccaattatatgcactatagaaaaagtaatcatagagggggaaatgagaaagcaacatgaggaaaaaggtgaccaagaattggtcctttcaaacgcagatagcaataaagacaaaagctttcacaaaaattgattgatatggcaaagcaaaacaaaacaaaatcagcaatggaagctaaccaaattcaatatattttttagatctttccctactttgcttctaatgcttttcttctttatctttatgtatttttccctttaatactctctttgactaagcactcactttcatagtacacatgcacgaacacattaggcctcagtgatgcaaacaactgagtaaatgggcgtctcatcggtcacttcacactacaacatgatcacattttttttttttacctttaacattttttttacttttttttttttatgtatccttaattttaaaacagaatgtaactactaacaatattctataacccaaaaaaaatcctgattaacgaaaagcataggaacccaattaatttagtttttaaagaatagatccgttgaaactccctcaactaacaaaaaaattactaagagaaatgattcaaattaattttcaattaagaaaacatgcattagtttaagtggttaaagcccttgttggcatatcatagtactagtttgaatttaattagatatagaaatagagaaatgtgtctgatgacagaaattaataattctttttgggagcatcaaagagaacaaatataaattaaatgtcttgggtttctataattgctgtcaaaacataacacaacggtccagagtccaaaccaacctggatatagtagggaccaagttttaacactcttttctcacaacaaccaaaaatcaaatagtactacaactggattatttagttatacaagagaggttaattagcattaattaatttactaatcagaaactaatactagtaccaattttttttgaaaaagagagagtaataataataaaaacaaaggagtgatgaaattcaaaatattgggacacttcctcagagtaatcaaaaatggcacagattttatgaataaaataagaatgaaaaggactgtttttaaaatagtagtagtagtagtaataaaataaaagtattgagagagagagacttgcctcgagaaaaccaatctctctctcgagcatctgaactctcgccgcctctctgcgtttcccgtacaaatctggatactctggtggagacttaggacgaggcggtggtagagacgacggagcaagagacgatgaactcactccaccagcagctgattcttttcctcctccttcgccaccgccagaaggagcagacattttcggagagaaatggtttggagtgtctcaagagagaaacatgcagtggtgttattacttaggagagaagtgaaccagaagaagagaagaggaagcggcgagtgagtgagaaaaacaatgcaaagaagaaagaaaaagagaaagagagagagatgagtgtgtagtagt

SEQ ID NO: 68 - protein, 251 aa, Arabidopsis thaliana
MSAPSGGGEGGGKESAAGGVSSSSLAPSSLPPPRPKSPPEYPDLYGKRREAARVQMLEREIGFLEGEIKFIEGVQPASRCIKEVSDFVVANSDPLIPAQRKSRRSFRFWKWLCGPCLSLVSFCCCCQSKCSCHLRKPKCCNCTSCSCIGSKCCDGSCCSNICCCPRLSCPSCSCFRGCWCSCPDMSCCIPSCFRSCSCTRPSCLNKKKSSCCSCNCKIRWSSCFSCPKVRLCSCCFCNCKNLCSNPCCLAF

SEQ ID NO: 69 - DNA, 1200 bp, Phoenix dactylifera
atggcggccgcggacccgcgagcgacgatgacgacgccgccgagcccgaagtcgccgcccaggtacccggatctctgcggccggcggaggctgctgctcgaggtgcagatcttgaaccgggagatcggcttccttgaggaggagttacaatcgcttgaaggacttcaacctgtctcacggtgctgcaaggaggtcaacgaatttgtggggataaaaccagatcctctaatacctataaataagaagagacacaagtcttgtcgcatttggaggtggcttggatcgaaactttgcctctgcttctcatggatgtgctgctccagcggaagcttgctagagctcaaaagaccgagctgcaaatgcccatgctcaaagacttgcagctgttgccaaaggaattgcaactgttacccagagaattgcagctgtcgcccaagtatctgcaactgttgcccagagaattgcaggtgtcgcgactgtttcccaaacaactgcacctgctgccctaaggactgcaaatgcgactgctgccctaaggactgcaactgcgactgctgccctaaggactgcagctgcgactgctgcccgaagagctgcgcgtgctgcccgaagagctgcccctgctgcccgaagagctgcgcatgctgcccgaagagctgcagctgctgcccgaagagctgcgcgtgctgcccgaagagctgcgcgtgctgcccgaagagctgcgcgtgctgcccgaagagctgcagctgctgtccgaagagctgcagttgtttcccgaagagctgcgcctgttgcccttccgaatgtgaatgcccttgttgcccttgctgtgaggtcccatcctgcagaccaagctgcaattgctgcgagggtttcttctgcaaaacacatggcagctgccttgatgtttcctgctgtaggccctgctgcaattgctcggagctttcctgcttcaagtctgtttgctgcaattggggtgtttcatgcttcaaatcccaatgctgtaccaggggattttcctgctccaaaccacgttgctgtggttggggttttccttgctccaaaccacgatgcatccttccaagcgtctcctgccctgagtattcctgtggctgtatctggtcctgcccaagatgtacagaggtacgcctgtgcccaagatgctctaaaacttgctgtcgtagtggatgtctatgttag

SEQ ID NO: 70 - DNA, 1665 bp, Phoenix dactylifera
ttgcagcgagaccggacaataagcacgctcgagccggggcgagcgaagagatatgggggctgtttgcgcggcgtggaatggggcggtgaccgcatcgttgctgttcctcctgtcctccgccgcgtaccgcatttataaccctgcagtacctcccctccccactccccctctgtgccgggctcgcagtcggtgtcccctcccctcctgccccgcgcgcccaacttaccgcggcgcgcagtaacgccccctttactattacttaaactctccctcggatatatgctgctgctgctgcggctgctgctgctattcacgctgcggaagcattggatccggtgagtcgccaacgataatggcggccgcggacccgcgagcgacgatgacgacgccgccgagcccgaagtcgccgcccaggtacccggatctctgcggccggcggaggctgctgctcgaggtgcagatcttgaaccgggagatcggcttccttgaggaggagttacaatcgcttgaaggacttcaacctgtctcacggtgctgcaaggaggtcaacgaatttgtggggataaaaccagatcctctaatacctataaataagaagagacacaagtcttgtcgcatttggaggtggcttggatcgaaactttgcctctgcttctcatggatgtgctgctccagcggaagcttgctagagctcaaaagaccgagctgcaaatgcccatgctcaaagacttgcagctgttgccaaaggaattgcaactgttacccagagaattgcagctgtcgcccaagtatctgcaactgttgcccagagaattgcaggtgtcgcgactgtttcccaaacaactgcacctgctgccctaaggactgcaaatgcgactgctgccctaaggactgcaactgcgactgctgccctaaggactgcagctgcgactgctgcccgaagagctgcgcgtgctgcccgaagagctgcccctgctgcccgaagagctgcgcatgctgcccgaagagctgcagctgctgcccgaagagctgcgcgtgctgcccgaagagctgcgcgtgctgcccgaagagctgcgcgtgctgcccgaagagctgcagctgctgtccgaagagctgcagttgtttcccgaagagctgcgcctgttgcccttccgaatgtgaatgcccttgttgcccttgctgtgaggtcccatcctgcagaccaagctgcaattgctgcgagggtttcttctgcaaaacacatggcagctgccttgatgtttcctgctgtaggccctgctgcaattgctcggagctttcctgcttcaagtctgtttgctgcaattggggtgtttcatgcttcaaatcccaatgctgtaccaggggattttcctgctccaaaccacgttgctgtggttggggttttccttgctccaaaccacgatgcatccttccaagcgtctcctgccctgagtattcctgtggctgtatctggtcctgcccaagatgtacagaggtacgcctgtgcccaagatgctctaaaacttgctgtcgtagtggatgtctatgttaggttagatcatggcattgtattcctcttagcgtccagtttttttgacatgcatattattctattggaattctgaatcataatatatttgaaattaaaatttttgtcctgttatc

SEQ ID NO: 71 - protein, 399 aa, Phoenix dactylifera
MAAADPRATMTTPPSPKSPPRYPDLCGRRRLLLEVQILNREIGFLEEELQSLEGLQPVSRCCKEVNEFVGIKPDPLIPINKKRHKSCRIWRWLGSKLCLCFSWMCCSSGSLLELKRPSCKCPCSKTCSCCQRNCNCYPENCSCRPSICNCCPENCRCRDCFPNNCTCCPKDCKCDCCPKDCNCDCCPKDCSCDCCPKSCACCPKSCPCCPKSCACCPKSCSCCPKSCACCPKSCACCPKSCACCPKSCSCCPKSCSCFPKSCACCPSECECPCCPCCEVPSCRPSCNCCEGFFCKTHGSCLDVSCCRPCCNCSELSCFKSVCCNWGVSCFKSQCCTRGFSCSKPRCCGWGFPCSKPRCILPSVSCPEYSCGCIWSCPRCTEVRLCPRCSKTCCRSGCLC

SEQ ID NO: 72 - DNA, 1116 bp, Zea mays
atgggggaggaggtggcggtggtgctggagcccccacggcccaagtcgccgccgaggtacccggacctgtgcggccgccgccggctgcagctggagctgcaggccctcaaccgcgagatcgacttcctcaaggacgagctacaatcactcgaaggtgttccaccagtctctagaagttgtaaagaggtaaatgagtttgttggtacaaaacaagacccactaataccgataaagaagaagacgcacagatcatgccgtcttttttggtggatcagatcaaaattgtgcatatgcgtgtcatggttctgttgctcctgccattgcttgcccagctgcaaaaggccatgctgcctggattgctcctgctgctcatgcccagatctgtcatgctgcaagcccagctgcaaatcatgcaacaaaccctgctttgggcccaacagctgttcatgttgcgacatatcatgctgcaagccagattgcccatcctgtagttcaaactgcagctcgtgctgcaccggcagtccatcatgctgtaaaccaaactgcaacacctgctgcagaccaaactgtagctcgtgctgcgatccgtcatgctgcaaaccgaactgcagctgcttcaagaccctctcgtgctgcaaattccagtgcagcccaaactgctgcacctgcagcctcccgagttgctccggctgcaacccctgcggcagttgcaagaaatgctggtcatgccccagcgactgcaagccaagctgtggctgtttcagcgcgcaatgttgcagctgcgcgggatgctgctcgtgctcaagctgtttcagttgcttcggttgtttcaagtccttcaagtgctccaacctgtttgggtgctgctcctgcaagcagtgcttcaagtgccagtcctcgtgctgcaagggggcgtcgtcctgctgcaaatgccagtcgtcgtgctgtgagggtgaagacggcagcagctgctgccggaggccatgctgcacttttccgaagccagcttgctctgggtgttcgtgcgggtgcgcttggtcctgcagaaagtgtacagaatggtgtcgatgttccgggtgccgcaatccgtgctgtgccactggatgcttgtgttga

SEQ ID NO: 73 - DNA, 1733 bp, Zea mays
tcctcccctgctctcccgtttctctctctctctcaaccccacgcccccttctctgccattattgcccgcgcagccatcctctctctctctccctcccgctcagtaatcagtatatggggacgtcctgctcctcgcttcctcatccaatcctcccacttcctcttcttcctctcatcctgcttcccctcgcgtgcgcagacacgagcgcgcgtgtccgtcactcccgtgcgtgcgatatcctccacccgcctcagcccgctgtccccctgctcatcgcccgatcgccgcgacttataccaccatcagccagccaccactccctcctcaacattccgcttctctagtcccgaacaccggccggcactcgttagggggaggtgtgccggtgtgggaggtactctgctagccgccagtacatgtgaggtccatgggggaggaggtggcggtggtgctggagcccccacggcccaagtcgccgccgaggtacccggacctgtgcggccgccgccggctgcagctggagctgcaggccctcaaccgcgagatcgacttcctcaaggacgagctacaatcactcgaaggtgttccaccagtctctagaagttgtaaagaggtaaatgagtttgttggtacaaaacaagacccactaataccgataaagaagaagacgcacagatcatgccgtcttttttggtggatcagatcaaaattgtgcatatgcgtgtcatggttctgttgctcctgccattgcttgcccagctgcaaaaggccatgctgcctggattgctcctgctgctcatgcccagatctgtcatgctgcaagcccagctgcaaatcatgcaacaaaccctgctttgggcccaacagctgttcatgttgcgacatatcatgctgcaagccagattgcccatcctgtagttcaaactgcagctcgtgctgcaccggcagtccatcatgctgtaaaccaaactgcaacacctgctgcagaccaaactgtagctcgtgctgcgatccgtcatgctgcaaaccgaactgcagctgcttcaagaccctctcgtgctgcaaattccagtgcagcccaaactgctgcacctgcagcctcccgagttgctccggctgcaacccctgcggcagttgcaagaaatgctggtcatgccccagcgactgcaagccaagctgtggctgtttcagcgcgcaatgttgcagctgcgcgggatgctgctcgtgctcaagctgtttcagttgcttcggttgtttcaagtccttcaagtgctccaacctgtttgggtgctgctcctgcaagcagtgcttcaagtgccagtcctcgtgctgcaagggggcgtcgtcctgctgcaaatgccagtcgtcgtgctgtgagggtgaagacggcagcagctgctgccggaggccatgctgcacttttccgaagccagcttgctctgggtgttcgtgcgggtgcgcttggtcctgcagaaagtgtacagaatggtgtcgatgttccgggtgccgcaatccgtgctgtgccactggatgcttgtgttgactgttgaggttgaactagacgtttccttggttgttatttttttgcgtctgccgtttagatgaccgttagtttcgttcgtgctttgatatatggtgtggcgtccttgtctgtaaagaaatcccatatcactagaagaaattgaagcgtcaatagtcatcaactgctataaaattcagatgccttttaagaa

SEQ ID NO: 74 - protein, 371 aa, Zea mays
MGEEVAVVLEPPRPKSPPRYPDLCGRRRLQLELQALNREIDFLKDELQSLEGVPPVSRSCKEVNEFVGTKQDPLIPIKKKTHRSCRLFWWIRSKLCICVSWFCCSCHCLPSCKRPCCLDCSCCSCPDLSCCKPSCKSCNKPCFGPNSCSCCDISCCKPDCPSCSSNCSSCCTGSPSCCKPNCNTCCRPNCSSCCDPSCCKPNCSCFKTLSCCKFQCSPNCCTCSLPSCSGCNPCGSCKKCWSCPSDCKPSCGCFSAQCCSCAGCCSCSSCFSCFGCFKSFKCSNLFGCCSCKQCFKCQSSCCKGASSCCKCQSSCCEGEDGSSCCRRPCCTFPKPACSGCSCGCAWSCRKCTEWCRCSGCRNPCCATGCLC

SEQ ID NO: 75 - DNA, 1203 bp, Sorghum bicolor
atgggggaggaggtagcggcggcggcggcggtggtgctggagccgccacggcccaagtcgccgccgaggtacccggacctgtgcggccgccggcggctgcagctggagctccagatcctcaaccgcgagatcgacttcctcaaggacgagctacaatcactagaaggagttccaccagtttctagaagttgtaaagaggtaaatgagtttgttggtacaaaacaagacccactactaccgataaagaagaagacgcacagatcttgccgccttttttggtggatcagatcaaaattgtgcatatgcgtgtcatggttctgctgctcctgccattgcttgcccaactgcaaaagaccatgctgcttggattgctcctgctgctcatgcccagatctgtcatgctgcaagcccagctgcaaatcatgcaacaagccctgctcttggcccaacagctgttcatgttgtgacacaccatgctgcaagccagattgcccatcctgtagttcgagctgcagctcgtgctgcaatctgtcgtgttgcaacccgaactgtagctcgtgctgcacctgcaatccatcatgctgtaaaccaaactgcaactcgtgctgcagaccaaactgtagctcgtgctgcaatccgtcatgctgcaaacctaactgcggctcatggtggaaaccgagctgcagctgcttcaaggccccctcgtgctgcaaactccagtgcagccccaactgctgcacttgcagcctcccgcgctgctccggctgcaacccctgcggcagttgcaagcagtgttgctcatgccccaccgactgctgcaactgcaagccaagctgcggctgtttcagcgcgcaatgttgcagctgtgcggcatgctgctcctcgtgcttaagctgcttcagttgcttcggttgcttcaagtccttcaagtgctccaacctgttcgggtgctgctcctgcaagcagtgcttcaagtgccagtcgtcgtgctgcaagggtgcgccatcctgctgcaagtgccagtcgtcgtgctgtgagggtgaagacggcagcagctgctgccggaggtcatgctgcagtgttccgaagccggcttgccctgggtgctcgtgcgggtgcgtttggtcctgcaagaagtgtacagatgggtgtcgatgttctgggtgccgcaatccgtgctgtgccactggatgcttgtgttga

SEQ ID NO: 76 - DNA, 6752 bp, Sorghum bicolor
gcctcctcctctgcttccttgctctcaccctgcttcccgttcgcgcgcgcgcagacacgagcttgttgtccgccactcccgcctcgtacgtgcgctatcccccaccgcctcagcccgctgtccccctgctcatctcatctcatctcatcgccgcgatttataccaccaccaggaaccagccagccagccaccactccctcctcctcagcattccgcttctctactctagtctagtccccaacaacaacaccggcgggggctagctcgttaggcgtgcgtgggagctactctactctactgctagccgccgcctagctagctaggcctatccggccagtagtacatgtgaggtcggtccatgggggaggaggtagcggcggcggcggcggtggtgctggagccgccacggcccaagtcgccgccgaggtacccggacctgtgcggccgccggcggctgcagctggagctccagatcctcaaccgcgagatcgacttcctcaaggtgaggcatacatcatcgccggcactactaccgttccttcctgtctgtctcgtcgtcccccttcggtcaaccggttgccatgctctctcttcgacttccccctttgacttgccccaattaaaaaaccttcaaaaaaatcaccaccagcactagtagcagtaggatccgattcgtcgcgcgatctcgttttctttgggccgtgcggtgtgtacaagcggccactactggtactagcgcgcgggggggtggggggatgagtagttgtttaatggcagattggtgcgaaaatctgatcgttggagcacgccacgccatttatttcgtcttcgtttttggggatgagagcctaatgcggaggcggggaggggaggggaggggagggagggcggcggatcgcggcagcgcagttaaacccgaggcgcgacagggtttgcccagttgccgtcttggggcgtgccgcgggctgtacctcttgggccgtgcggttcggttccttgggagaaaagagagacgggggacggcatgggcagtgccgcgccgcagtggccagtggcactggcactggcactggcactggcactggcgcgctgcccgactgcccgtgtcagtgctgcgcgtggagcagcgagtgggcgtgtccccttctcgttcttgcttcgcggacacgcacacggcacacggcatggctcgtcaggcactatcatgatgagggttcgtgcagcagagaggcaaaggtgatgcgcggcgcacggcgcgccgtaccgtactgtacatgtactactactggtgtttatgggctgggctgcctttccatgctccggactattagattttgtgtatattttttttaatcaagggaaacgagtgtctttttgacgcccgtgctctgctttaaggtgcaggtttgggatgctgtccaggtgattaaagcacttctttactggtcaagtgtgctttggtcttctttttatctcttcttgcaacttcagttgcttttccaagctcagcaaagcaggggacttattattagtcaattacttatctcaccgtgtttgagactagaatccacctttttaaatcggtctgtcggatgtctcgggttcacgtaggccctatttccgtcgccactcaccacgcaacagctcgccgtgctgcaagtgtggtgtttgattagcgccgcagcttagacacgtcgcagagatgccacaaccagctagttcatttttgtccgatgcagcttaggactgctttggcgaggagcggtgactacagcatcgaaacatgccaaggccacacctaatataggatgtccaaaggtatacgtagttgccagcggcagtcaatgaatgccatgaatctatggggtggagactgtcacgcggcagggaggatgagagaaggcagctgatctggctagtttgtgtttcgttgatggtgaattagagaagggaaccggagagaagggaatgaagagagagggctcagagatggattcaggtcccctctctgtacaaaagaaaacatgtttgccagagaacatgtgtgtgcatgtacgaggtggtaagcgaacggttattttacttacgctcagcagcaatgctcataaaccaaacggttgctagagaagtttgccaagcttttggcagctcatgtggctgagaatccaaacggttgccagaaaagtttgccaaccttttggcagctcatgtggctgagatccaaacggttgccacagtgggactaagtttaaccaaccaaatggttatattctgccacaatttaggtgtgccacaagtttggcatatgcctaagcttagttatggcaacctgtgtctgccacccaaataggattgccaaggtggcattgggagtggctagtgaagtgatgtttgtctagtggcttgatggattcagtgtttgccaccacataatttatttttccgacagagaatttttagttaaactgtcctcattctcttttgaaaatgttctgcacaacgaatctacacataagatattgtttgtttggggcaaataacaaatagctatgcatatttgaaatgtttagtgttccctttatattatttctcatgggtaatcaggcttacagttggcaaccatgtttctttgggaccactttcatgagtagcatacaaagtaacaattgcttttgtttgacagcaatctgattttgcaggacgagctacaatcactagaaggagttccaccagtttctagaagttgtaaagagtatgcactgctgcccttcctgcattgcatattactctttccttggcatctgttgctaatgtcatgtaggccttgtttagttcgcaaatttttttgtttttgggtactgtagcatttcgtttgtatttgacaaacattgtccaatcacggagtaactaggctcaaaagattcatctcacaaattacaggtaaactatgcagttagtttttattttcgtctatatttaatgctccatgcatgcgactaaagattcgatgtgacggggaatcttgaaaatttttgcgaactaaacaaggccttaggatgaaatcctggtttcacgtcaaatgacattgttttttttttggcactaattttcacttttctgtttcttatatcttgccgcacaaaaatgttattggttaattgtactttaacccaagtcagtgtcagtatggtctatggaggctattgtttaaccccacacagatcacagtgttcggtacatggtttggttttgaatgtccactttcttttagcttgtggcccagttagtgatccattccagcatttttcttcctacttcctggaggcctcaagtattaactgataatattttggttaccatgttttctacatttggtcaaatactattaataattgttagtcaaaattttcttaatgctgtatttagctctccaagttctgaattcgtcacttgtattgaaattgttttctcggtggagtgtgcatatgcatatgcagttgggaaggttattaaactattgcctactgaattatttcatagtcactgttacgataattctctgtttttttttgccaaacttcagctatattgcatagttttcttcacagtttggagcacattctgtttatattttttctaacatcatctcatttaaaaccttccagggtaaatgagtttgttggtacaaaacaagacccactactaccgatgtatgatccataggcttgatgttataattacattgaagcatctacaaaggctattatgaattgacttcctttgatttttcagaaagaagaagacgcacagatcttgccgccttttttggtggatcaggtatgcattccattacttattcttgtcagtgattgtatagctggtgcattaaaatcttcgtaatattcacctcagaaagttatacattagatgaattagcaaattttctcctgtatttcttcttggacaatgcgagttaattactcttgcatctcaatgagcaaatttgaactttgttggtccagaagtggcaaatcccccaacacacacacacacacctgttttagtctcattttcttggtactggagttttttttttaaaaaaaaatcttcatgtaacctatcatcgctgctttgtactcctaaataattgtgggccatcaatttaactagatctaggtaataggtgaaatatatatttttttattttttattttgtaaaataaaacaaggtgaattgggatttttttttgttttagattaagaatctttcttttagatctaataattacatgcatgacttattggatgtaacatatgtaattgtgattagttggaagcgttaggttttttttgtgtgtgtgtggaacacgtgttaattggtacaacaccggcacctgtctgttcacacccaggaaatatactgtataacatgtagacatacatggtaaatgataaacgagaattattcttttcctgagatttcttttttctttttctggtttcaaaagccaatgcctgtgattgaagtactgtagcaaggcccctaactaaaacaatgtcacactgaagcaaaatggctgtcaatttttattccagaaatagtgatgtctgcatggtattgtacaaaccttctcttggactagaaacacactgagccattgtgggattactcttactgaactttgtggcatagtgcttgttggcacataacttaccattttcttaattgtttgttaatgtgcgaagaccatatcacattttttactgcgatctaaatctaataccactatattttcttctatgtatatgagcttatagtttgatttgttcctcgcattggtactatgcaacacacatttgttcatttcaggccgccttgtttagttctcaaaaagttttgccaaaaattttagatttcccgtcacatcgaatcttgcagcacatgcatgaagtattaaatatagacaaaaataaaaactaattacacagttacctgtaatttgtgagacgaatcttttgagcctagttagtctatggttggacaatatttgtcaaataaaaacgaaagtgctacagtacccgaaaccccaaaattttgccaactaaacaaggcccgttggggagaaaaaaatttgggtgtcacatcggatgttttgtaggatgttggaaggggtgtttggatactaataaaaaaactaactacataactcaggctggaaactgcgagacgaatttattaagcctaattaatctatcgttagcacatgtaggttactgtagcacttaggatgtttcataggatgtcggaaggagtgtttagatactaaacaaaaaactaattacataactcggctgaaaactgcgagacgaatttattaagcctaatgaatctattgttaccacatgtaggttactgtagcacttaaggctaatcatggattaactaggcttaaaagattcgtctcgtgatttctaactaaactgtgtaattagtttattttttttatctatatttaatactccatgtatgtgtccatagacgggtgaaaattttttggtggaaatttttgggttggaaacaaggcctcatatttgagtttctgcaatttgaagatgctgatattactgtttttccctccatgcagatcaaaattgtgcatatgcgtgtcatggttctgctgctcctgccattgcttgcccaactgcaaaagaccatgctgcttggattgctcctgctgctcatgcccagatctgtcatgctgcaagcccagctgcaaatcatgcaacaagccctgctcttggcccaacagctgttcatgttgtgacacaccatgctgcaagccagattgcccatcctgtagttcgagctgcagctcgtgctgcaatctgtcgtgttgcaacccgaactgtagctcgtgctgcacctgcaatccatcatgctgtaaaccaaactgcaactcgtgctgcagaccaaactgtagctcgtgctgcaatccgtcatgctgcaaacctaactgcggctcatggtggaaaccgagctgcagctgcttcaaggccccctcgtgctgcaaactccagtgcagccccaactgctgcacttgcagcctcccgcgctgctccggctgcaacccctgcggcagttgcaagcagtgttgctcatgccccaccgactgctgcaactgcaagccaagctgcggctgtttcagcgcgcaatgttgcagctgtgcggcatgctgctcctcgtgcttaagctgcttcagttgcttcggttgcttcaagtccttcaagtgctccaacctgttcgggtgctgctcctgcaagcagtgcttcaagtgccagtcgtcgtgctgcaagggtgcgccatcctgctgcaagtgccagtcgtcgtgctgtgagggtgaagacggcagcagctgctgccggaggtcatgctgcagtgttccgaagccggcttgccctgggtgctcgtgcgggtgcgtttggtcctgcaagaagtgtacagatgggtgtcgatgttctgggtgccgcaatccgtgctgtgccactggatgcttgtgttgaggttgaactagacgttttctttggttgttattttttgcgtgtgccattttagatggccgttggtttccgtcgtgctttgatatatggtgtggcgtccttgtctgtaaagaaatcccatgtcaccagaagaaattgaagcgtcaatagtagtcatgaagtactacaaaatttagatgccttttgaccttcat

SEQ ID NO: 77 - protein, 400 aa, Sorghum bicolor
MGEEVAAAAAVVLEPPRPKSPPRYPDLCGRRRLQLELQILNREIDFLKDELQSLEGVPPVSRSCKEVNEFVGTKQDPLLPIKKKTHRSCRLFWWIRSKLCICVSWFCCSCHCLPNCKRPCCLDCSCCSCPDLSCCKPSCKSCNKPCSWPNSCSCCDTPCCKPDCPSCSSSCSSCCNLSCCNPNCSSCCTCNPSCCKPNCNSCCRPNCSSCCNPSCCKPNCGSWWKPSCSCFKAPSCCKLQCSPNCCTCSLPRCSGCNPCGSCKQCCSCPTDCCNCKPSCGCFSAQCCSCAACCSSCLSCFSCFGCFKSFKCSNLFGCCSCKQCFKCQSSCCKGAPSCCKCQSSCCEGEDGSSCCRRSCCSVPKPACPGCSCGCVWSCKKCTDGCRCSGCRNPCCATGCLC

SEQ ID NO: 78 - DNA, 852 bp, Triticum urartu
atgggggagggcgcggtggtggtgctggaggcgcccaagcccaggtcgccgccgaggtacccggacatgtgcggccgccggcgcctgcagctggaggtgcagatccttgaccgcgagctcacgttcctcaaggacgagctacatttacttgaaggggctcaaccagtctcacgttctgcttgcttgaaagaggtaaatgagtttgttggtacaaaacaagatccactgataccaattaacaaaaggaagcatcggtcctgccgtctttattggtggatcagatcaaaactgtgcgtatgtgcttcatggctgtgctgctcctgccaatgcctaccaacctgcaaaagaccaagctgcttggactgttcatgctgcgagccaaactgctcgtgctgcagcccgaactgccgcagctgcttcaagatcccttcgtgctgcagcaaaccacagtgctgcagcggcggctgtaacccttgcggcgagtgcaagccggagtgtggctcttgttccgccggtggctgctgcggcgactgcaagccaagctgcagctgctgcggcgagcagtgccagtgctgctcctgccctcgatgcacggggggctgcttcaagctcccgaaatgctcgtgcgcgcagtgcttcaactgccagtcgtcgtgctgcaaggggcagccgtcgtgcttcaggtgccagtcgtcgtgctgcgacaagggcggctgctgcagcagcgggtcgtgcctgagctgcccgaagccgtcgtgcccggagtgctcctgcgggtgcgtgtggtcgtgcaaaaactgtacagacggatgccgatgcgcccggtgctgtgctggcgggtgcctgtgttaa

SEQ ID NO: 79 - DNA, 852 bp, Triticum urartu; identical to SEQ ID NO: 78

SEQ ID NO: 80 - protein, 283 aa, Triticum urartu
MGEGAVVVLEAPKPRSPPRYPDMCGRRRLQLEVQILDRELTFLKDELHLLEGAQPVSRSACLKEVNEFVGTKQDPLIPINKRKHRSCRLYWWIRSKLCVCASWLCCSCQCLPTCKRPSCLDCSCCEPNCSCCSPNCRSCFKIPSCCSKPQCCSGGCNPCGECKPECGSCSAGGCCGDCKPSCSCCGEQCQCCSCPRCTGGCFKLPKCSCAQCFNCQSSCCKGQPSCFRCQSSCCDKGGCCSSGSCLSCPKPSCPECSCGCVWSCKNCTDGCRCARCCAGGCLC

SEQ ID NO: 81 - DNA, 888 bp, Hordeum vulgare
atgggggagggcgcggtggtggtgctggagccgcccaagcccaggtcgccgccgaggtacccggacatgtgcggccgccggcgcctgcagctggaggtgcagatccttgaccgcgagctcacgttcctcaaggacgagctacatttacttgaaggggctcaaccagtctcacgttctgcttgcttgaaagaggtaaatgagtttgttggtacaaaacaagatccactgataccaattaacaaaaggaagcatcggtcctgccgtctttattggtggatcagatcaaaactgtgcgtatgtgcttcatggctgtgctgctcctgccaatgcctaccaacctgcaaaagaccaagctgcttggactgttcatgctgcgagccaaactgctcgtgctgcagcccgaactgctgcagctgcttcaagatcccttcgtgctgcaaaccgagctgcggctgcttcgggtgctgcagctgcagcaaaccacagtgctgcagcggcggctgtaacccttgcggcgagtgcaagccggagtgtggctcttgttccgccggtggctgctgcggcgactgcaagccaagctgcagctgctgcggcgagcagtgccagtgctgctcctgccctcgatgcacggggggctgcttcaagctcccgaaatgctcgtgcgcgcagtgcttcaactgccagtcgtcgtgctgcaaggggcagccgtcgtgcttcaggtgccagtcgtcgtgctgcgacaagggcggctgctgcagcagcgggtcgtgcctgagctgcccgaagccgtcgtgcccggagtgctcctgcgggtgcgtgtggtcgtgcaaaaactgtacagacggatgccgatgcgcccggtgctgtgctagcgggtgcctgtgttga

SEQ ID NO: 82 - DNA, 888 bp, Hordeum vulgare; identical to SEQ ID NO: 81

SEQ ID NO: 83 - protein, 295 aa, Hordeum vulgare
MGEGAVVVLEPPKPRSPPRYPDMCGRRRLQLEVQILDRELTFLKDELHLLEGAQPVSRSACLKEVNEFVGTKQDPLIPINKRKHRSCRLYWWIRSKLCVCASWLCCSCQCLPTCKRPSCLDCSCCEPNCSCCSPNCCSCFKIPSCCKPSCGCFGCCSCSKPQCCSGGCNPCGECKPECGSCSAGGCCGDCKPSCSCCGEQCQCCSCPRCTGGCFKLPKCSCAQCFNCQSSCCKGQPSCFRCQSSCCDKGGCCSSGSCLSCPKPSCPECSCGCVWSCKNCTDGCRCARCCASGCLC

SEQ ID NO: 84 - DNA, 1281 bp, Oryza sativa Japonica Group
atgggggaggaggcggtggtgatggaggcgccgaggcccaagtcgccgccgaggtacccggacctgtgcggccggcggcggatgcagctggaggtgcagatcctgagccgcgagatcacgttcctcaaggatgagcttcacttccttgaaggagctcagcccgtttctcgttctggatgcattaaagagataaatgagtttgttggtacaaaacatgacccactaataccaacaaagagaaggaggcacagatcttgccgtctttttcggtggatcggatcaaaattgtgtatctgcatttcatgtctttgctactgttgcaagtgctcacccaagtgcaaaagaccaaggtgcctcaattgttcttgcagctcatgctgcgacgagccatgctgtaagccaaactgcagtgcgtgctgcgctgggtcatgctgtagtccagactgctgctcatgctgtaaacctaactgcagttgctgcaagaccccttcttgctgcaaaccgaactgctcgtgctcctgtccaagctgcagctcatgctgcgatacatcgtgctgcaaaccgagctgcacctgcttcaacatcttttcatgcttcaaatccctgtacagctgcttcaagatcccttcatgcttcaagtcccagtgcaactgctctagccccaattgctgcacttgcacccttccaagctgtagctgcaagggctgtgcctgtccaagctgtggatgcaacggctgtggctgtccaagctgcggatgcaacggttgtggctgtccaagctgcggttgcaacggctgtggccttccaagctgcggttgcaacggctgcggctcgtgctcttgcgcccaatgcaaacccgattgtggctcgtgctctaccaattgctgtagctgcaagccaagctgcaacggctgctgcggcgagcagtgctgccgctgcgcggactgcttctcctgctcgtgccctcgttgctccagctgcttcaacatcttcaaatgctcctgcgctggctgctgctcgagcctgtgcaagtgcccctgcacgacgcagtgcttcagctgccagtcgtcatgctgcaagcggcagccttcgtgctgcaagtgccagtcgtcttgctgcgaggggcagccttcctgctgcgagggacactgctgcagcctcccgaaaccgtcgtgccctgaatgttcctgtgggtgtgtctggtcttgcaagaattgtacagagggttgtcgatgcccacggtgtcgtaacccatgctgtctcagtggttgcttatgttga

SEQ ID NO: 85 - DNA, 4701 bp, Oryza sativa Japonica Group
tctcttccctctctctctttctctctccaaaccccacgcacgccgcgtcgccgcctcctcctctccatctccgctgctattattgcccgcgcagacgcaggccaccatccttcctctcgctcacgctcgctgctatatgggggtcctcctcatcgcatcgcatcgcatcacctcgcacgggcgcgcgcgccgtgccgtgccgctagctcgatccgcctcgtacgccagctcgctcgctcgctcccccaccccgctgctgcacggctgcgcccgcgctgtcccctgtccccccgctcgccgcggcgatttatacccaccacgccccctgctgctgctataatgcccatgagtgaaggcggcgaggggtggttctgagttggccgttggcgtgctgcgtgtggagatgggggaggaggcggtggtgatggaggcgccgaggcccaagtcgccgccgaggtacccggacctgtgcggccggcggcggatgcagctggaggtgcagatcctgagccgcgagatcacgttcctcaaggtgagcgccccgcggcggcggcggctgcgtttttctctataggtttctctttcacactcgctcgctcgaaattctcggggcccgagctctacttgcttcgtcttcctttgactttaccgattaattttaaaaaaaaggagatccgattcgccgcgcatttttcaaaacccaagcggccgagtacggagctacccgctactgcaagtaggatgctgtgaagtgtacagtaatggcgttgttaattgcggtagctagtgctattctagtacttgtagtactgtttctaggcggaggtgaatcacggcgccatcaatccgaggctggcgagacaagcttggccctctttgggcgtggcgccatggctgtactacctttgtcgttgtttggttgggctcctcgttggagaaaagaagagcgtgggcatggacaactgacctgagtggccttgtcagggagagccatagcagtggacgtgtctatctccgccattgcttcgtcgacactggacgtgcagacggcatggccatgagggctttgcacgatgggtggtgccgtgttggtgttatgggctgccaccatggtttgaggcttttgatgttgctagattttgtgtttaacgagggagggaagaatgtgttgttcttgacactgtgctgtgcttttaaggagcagagatttcagaagctcttcagatatcagagaacttctttgtagtagtaatcaaatgcgctttagacatctttttatcgtttcttgcaaggtcagtccctgctttggtacccgatctcgcttttgtgcaacatcaaagttacacttacacagtaaagcaggaatctttatgggaccgttcgtactggtcaattactccaggctttgattaatgggttttaagttttaaccgcagatttggtacaagtaacaacctttatttactttttatttctgcaactgtgtcttttaacatgaaagaatccagctccattcaaaagtttagtttttattttccattgtggtgcatggtcactcagcctgcagtactgaattatcaaaattttcttttgtcatttctctcatgttaagtgcatagtctattttacttcaacaggtagaaaaacttttgtgggtttgtttctagctcaaggaggaaattcatgggtttgcatctagcacatgagagaacaatattggtctaacacaaagctccttttgtaggatgagcttcacttccttgaaggagctcagcccgtttctcgttctggatgcattaaagagtatgtactactgcccttcatgcattacagatattttgtttttaagtttttagaaatttgaagagcttatgtcaagtatgaaatgtcagcttaattttattgctgtccttatctaatgtcttatgctctgttttataaaatttggttgcattttctcccccagggaaaaatcttgtataagtgtgttatgtacttatgtgtataaaatcttgttgcacttgtatgtcacacttaggccctgtttagatcctccaaaatggcagtttgccattttgaagaaccttttgccattttggatctaaacactagtaacaaaacttggcaatttggcatttggcatttgctagtctatagtagcaaattgtgccaaaaagtgctttggaaccactctctctttctttctctctctcactttagtgctagaatggtaaaagtttaggatgcatctaaacaccaactagtacttttacaatactaaaacttttgccaccaaaacttttgccatttgccatttgctatttcaaatggatctaaacagggccttagcaaatcaccatatgttaaaattaccttgggatgaaaaagaaaaaggaaaccagcattgaagtcttgtttgaaatgcatatgtacttgtaccattacagaaattcttaaaactgctgtcttgacagctacttatcaaacagccccacctgcatcataacgttcctagtggtgcctataactctgcctcagttattattttgtggcccactggtccaacaatttgaaaaaaattatattgaactaaatatattgaacagtagtatgacgtcctctttgcttgagttccatattacagctcacagtcctgagatttgtttcaccgattctttccatgcgatgtgcacatattcttattcaatttaaaaaatgaaagcagattatttttaacaagtaacctatcacgttagcttaacattgtatatttgtggtggaattatgtaatattccgatatcgcatttgaagttttgaacatgtgtgctcaaattgagggacacatgactgtagtgaaagcaaatataaatgtctgagcaatggactatactttgtattcattactacaagttatgtccttttgcaggttgctaatgtcctcttacattacttgtcaggataaatgagtttgttggtacaaaacatgacccactaataccaacgtatggcctctaaactttcagttcccccattttaagcatgttcgctgtttatttacgagttttgacattgttttttccttttccagaaagagaaggaggcacagatcttgccgtctttttcggtggatcgggtatgttttgatccaatatagtttgctcgcaggttctgaggggcaagaacattcaaatatctataatgttttctgttggattcaacattcatcactatttccctcgaaaaaaaagcattcgtcactattggaattgaaagtctgaaagtgcctctagtccctttgtatgttaaaagtcaataaacaagcagtagttttctatatgccacattaatattattgacgcattttaaaaagcaaactagtccagggatgtaatcatctttgttatctaaaactaaaaaaggaaaaactagtgcttttttacattaacattgatttttttgcggctgaaattacatgtagaaactttggcataataatctgtactactgccaaactgagcttttacatggtgaaaatattttccctgcagatcaaaattgtgtatctgcatttcatgtctttgctactgttgcaagtgctcacccaagtgcaaaagaccaaggtgcctcaattgttcttgcagctcatgctgcgacgagccatgctgtaagccaaactgcagtgcgtgctgcgctgggtcatgctgtagtccagactgctgctcatgctgtaaacctaactgcagttgctgcaagaccccttcttgctgcaaaccgaactgctcgtgctcctgtccaagctgcagctcatgctgcgatacatcgtgctgcaaaccgagctgcacctgcttcaacatcttttcatgcttcaaatccctgtacagctgcttcaagatcccttcatgcttcaagtcccagtgcaactgctctagccccaattgctgcacttgcacccttccaagctgtagctgcaagggctgtgcctgtccaagctgtggatgcaacggctgtggctgtccaagctgcggatgcaacggttgtggctgtccaagctgcggttgcaacggctgtggccttccaagctgcggttgcaacggctgcggctcgtgctcttgcgcccaatgcaaacccgattgtggctcgtgctctaccaattgctgtagctgcaagccaagctgcaacggctgctgcggcgagcagtgctgccgctgcgcggactgcttctcctgctcgtgccctcgttgctccagctgcttcaacatcttcaaatgctcctgcgctggctgctgctcgagcctgtgcaagtgcccctgcacgacgcagtgcttcagctgccagtcgtcatgctgcaagcggcagccttcgtgctgcaagtgccagtcgtcttgctgcgaggggcagccttcctgctgcgagggacactgctgcagcctcccgaaaccgtcgtgccctgaatgttcctgtgggtgtgtctggtcttgcaagaattgtacagagggttgtcgatgcccacggtgtcgtaacccatgctgtctcagtggttgcttatgttgatctagatccttttttggttgttgtttttcttgtattttttagttgttaggcctttgattaagttcgaactttcataaatatatggtgtttatcctgtaaagaaatgatgatttcaaggatttttcatagctatgagacgaggttgaacc

SEQ ID NO: 86 - protein, 426 aa, Oryza sativa Japonica Group
MGEEAVVMEAPRPKSPPRYPDLCGRRRMQLEVQILSREITFLKDELHFLEGAQPVSRSGCIKEINEFVGTKHDPLIPTKRRRHRSCRLFRWIGSKLCICISCLCYCCKCSPKCKRPRCLNCSCSSCCDEPCCKPNCSACCAGSCCSPDCCSCCKPNCSCCKTPSCCKPNCSCSCPSCSSCCDTSCCKPSCTCFNIFSCFKSLYSCFKIPSCFKSQCNCSSPNCCTCTLPSCSCKGCACPSCGCNGCGCPSCGCNGCGCPSCGCNGCGLPSCGCNGCGSCSCAQCKPDCGSCSTNCCSCKPSCNGCCGEQCCRCADCFSCSCPRCSSCFNIFKCSCAGCCSSLCKCPCTTQCFSCQSSCCKRQPSCCKCQSSCCEGQPSCCEGHCCSLPKPSCPECSCGCVWSCKNCTEGCRCPRCRNPCCLSGCLC

SEQ ID NO: 87 - DNA, 1281 bp, Oryza sativa Indica Group
atgggggaggaggcggtggtgatggaggcgccgaggcccaagtcgccgccgaggtacccggacctgtgcggccggcggcggatgcagctggaggtgcagatcctgagccgcgagatcacgttcctcaaggatgagcttcacttccttgaaggagctcagcccgtttctcgttctggatgcattaaagagataaatgagtttgttggtacaaaacatgacccactaataccaacaaagagaaggaggcacagatcttgccgtctttttcggtggatcggatcaaaattgtgtatctgcatttcatgtctttgctgctgttgcaagtgctcacccaagtgcaaaagaccaaggtgcctcaattgttcttgcagctcatgctgcgacgagccatgctgtaagccaaactgcagtgcgtgctgcgctgggtcatgctgtagtccagactgctgctcatgctgtaaacctaactgcagttgctgcaagaccccttcttgctgcaaaccgaactgctcgtgctcctgtccaagctgcagctcatgctgcgatacatcgtgctgcaaaccgagctgcacctgcttcaacatcttttcatgcttcaaatccctgtacagctgcttcaagatcccttcatgcttcaagtcccagtgcaactgctctagccccaattgctgcacttgcacccttccaagctgtagctgcaagggctgtgcctgtccaagctgtggatgcaacggctgtggctgtccaagctgcggatgcaacggttgtggctgtccaagctgcggttgcaacggctgtggccttccaagctgcggttgcaacggctgcggctcgtgctcttgcgcccaatgcaaacccgattgtggctcgtgctctaccaattgctgtagctgcaagccaagctgcaacggctgctgcggcgagcagtgctgccgctgcgcggactgcttctcctgctcgtgccctcgttgctccagctgcttcaacatcttcaaatgctcctgcgctggctgctgctcgagcctgtgcaagtgcccctgcacgacgcagtgcttcagctgccagtcgtcatgctgcaagcggcagccttcgtgctgcaagtgccagtcgtcttgctgcgaggggcagccttcctgctgcgagggacactgctgcagcctcccgaaaccgtcgtgccctgaatgttcctgtgggtgtgtctggtcttgcaagaattgtacagagggttgtcgatgcccacggtgtcgtaacccatgctgtctcagtggttgcttatgttga

SEQ ID NO: 88 - DNA, 4653 bp, Oryza sativa Indica Group
cctctccatctccgctgctattattgcccgcgcagacgcaggccaccatccttcctctcgctcacgctcgctgctatatgggggtcctcctcatcgcatcgcatcgcatcacctcgcacgggcgcgcgcgccgtgccgtgccgctagctcgatccgcctcgtacgccagctcgctcgctcgctcccccaccccgctgctgcacggctgcgcccgcgctgtcccctgtccccccgctcgccgcggcgatttatacccaccacgccccctgctgctgctataatgcccatgagtgaaggcggcgaggggtggttctgagttggccgttggcgtgctgcgtgtggagatgggggaggaggcggtggtgatggaggcgccgaggcccaagtcgccgccgaggtacccggacctgtgcggccggcggcggatgcagctggaggtgcagatcctgagccgcgagatcacgttcctcaaggtgagcgccccgcggcggcggcggctgcgtttttctctataggtttctctttcacactcgctcgctcgaaattctcggggcccgagctctacttgcttcgtcttcctttgactttaccgattaattttaaaaaaaaggagatccgattcgccgcgcatttttcaaaacccaagcggccgagtacggagctacccgctactgcaagtaggatgctgtgaagtgtacagtaatggcgttgttaattgcggtagctagtgctattctagtacttgtagtactgtttctaggcggaggtgaatcacggcgccatcaatccgaggctggcgagacaagcttggccctctttgggcgtggcgccatggctgtactacctttgtcgttgtttggttgggctcctcgttggagaaaagaagagcgtgggcatggacaactgacctgagtggccttgtcagggagagccatagcagtggacgtgtctatctccgccattgcttcgtcgacactggacgtgcagacggcatggccatgagggctttgcacgatgggtggtgccgtgttggtgttatgggctgccaccatggtttgaggcttttgatgttgctagattttgtgtttaacgagggagggaagaatgtgttgttcttgacactgtgctgtgcttttaaggagcagagatttcagaagctcttcagatatcagagaacttctttgtagtagtaatcaaatgcgctttagacatctttttatcgtttcttgcaaggtcagtccctgctttggtacccgatctcgcttttgtgcaacatcaaagttacacttacacagtaaagcaggaatctttatgggaccgttcgtactggtcaattactccaggctttgattaatgggttttaagttttaaccgcagatttggtacaagtaacaacctttatttactttttatttctgcaactgtgtcttttaacatgaaagaatccagctccattcaaaagtttagtttttattttccattgtggtgcatggtcactcagcctgcagtactgaattatcaaaattttcttttgtcatttctctcatgttaagtgcatagtctattttacttcaacaggtagaaaaacttttgtgggtttgtttctagctcaaggaggaaattcatgggtttgcatctagcacatgagagaacaatattggtctaacacaaagctccttttgtaggatgagcttcacttccttgaaggagctcagcccgtttctcgttctggatgcattaaagagtatgtactactgcccttcatgcattacagatattttgtttttaagtttttagaaatttgaagagcttatgtcaagtatgaaatgtcagcttaattttattgctgtccttatctaatgtcttatgctctgttttataaaatttggttgcattttctcccccagggaaaaatcttgtataagtgtgttatgtacttatgtgtataaaatcttgttgcacttgtatgtcacacttaggccctgtttagatcctccaaaatggcagtttgccattttgaagaaccttttgccattttggatctaaacactagtaacaaaacttggcaatttggcatttggcatttgctagtctatagtagcaaattgtgccaaaaagtgctttggaaccactctctctttctttctctctctcactttagtgctagaatggtaaaagtttaggatgcatctaaacaccaactagtacttttacaatactaaaacttttgccaccaaaacttttgccatttgccatttgctatttcaaatggatctaaacagggccttagcaaatcaccatatgttaaaattaccttgggatgaaaaagaaaaaggaaaccagcattgaagtcttgtttgaaatgcatatgtacttgtaccattacagaaattcttaaaactgctgtcttgacagctacttatcaaacagccccacctgcatcataacgttcctagtggtgcctataactctgcctcagttattattttgtggcccactggtccaacaatttgaaaaaaattatattgaactaaatatattgaacagtagtatgacgtcctctttgcttgagttccatattacagctcacagtcctgagatttgtttcaccgattctttccatgcgatgtgcacatattcttattcaatttaaaaaatgaaagcagattatttttaacaagtaacctatcacgttagcttaacattgtatatttgtggtggaattatgtaatattccgatatcgcatttgaagttttgaacatgtgtgctcaaattgagggacacatgactgtagtgaaagcaaatataaatgtctgagcaatggactatactttgtattcattactacaagttatgtccttttgcaggttgctaatgtcctcttacattacttgtcaggataaatgagtttgttggtacaaaacatgacccactaataccaacgtatggcctctaaactttcagttcccccattttaagcatgttcgctgtttatttacgagttttgacattgttttttccttttccagaaagagaaggaggcacagatcttgccgtctttttcggtggatcgggtatgttttgatccaatatagtttgctcgcaggttctgaggggcaagaacattcaaatatctataatgttttctgttggattcaacattcatcactatttccctcgaaaaaaaagcattcgtcactattggaattgaaagtctgaaagtgcctctagtccctttgtatgttaaaagtcaataaacaagcagtagttttctatatgccacattaatattattgacgcattttaaaaagcaaactagtccagggatgtaatcatctttgttatctaaaactaaaaaaggaaaaactagtgcttttttacattaacattgatttttttgcggctgaaattacatgtagaaactttggcataataatctgtactactgccaaactgagcttttacatggtgaaaatattttccctgcagatcaaaattgtgtatctgcatttcatgtctttgctgctgttgcaagtgctcacccaagtgcaaaagaccaaggtgcctcaattgttcttgcagctcatgctgcgacgagccatgctgtaagccaaactgcagtgcgtgctgcgctgggtcatgctgtagtccagactgctgctcatgctgtaaacctaactgcagttgctgcaagaccccttcttgctgcaaaccgaactgctcgtgctcctgtccaagctgcagctcatgctgcgatacatcgtgctgcaaaccgagctgcacctgcttcaacatcttttcatgcttcaaatccctgtacagctgcttcaagatcccttcatgcttcaagtcccagtgcaactgctctagccccaattgctgcacttgcacccttccaagctgtagctgcaagggctgtgcctgtccaagctgtggatgcaacggctgtggctgtccaagctgcggatgcaacggttgtggctgtccaagctgcggttgcaacggctgtggccttccaagctgcggttgcaacggctgcggctcgtgctcttgcgcccaatgcaaacccgattgtggctcgtgctctaccaattgctgtagctgcaagccaagctgcaacggctgctgcggcgagcagtgctgccgctgcgcggactgcttctcctgctcgtgccctcgttgctccagctgcttcaacatcttcaaatgctcctgcgctggctgctgctcgagcctgtgcaagtgcccctgcacgacgcagtgcttcagctgccagtcgtcatgctgcaagcggcagccttcgtgctgcaagtgccagtcgtcttgctgcgaggggcagccttcctgctgcgagggacactgctgcagcctcccgaaaccgtcgtgccctgaatgttcctgtgggtgtgtctggtcttgcaagaattgtacagagggttgtcgatgcccacggtgtcgtaacccatgctgtctcagtggttgcttatgttgatctagatccttttttggttgttgtttttcttgtattttttagttgttaggcctttgattaagttcgaactttcataaatatatggtgtttatcctgtaaagaaatgatgatttcaaggatttttcatagctatgagacgaggttgaaccattgaagcgcc

SEQ ID NO: 89 - protein, 426 aa, Oryza sativa Indica Group
MGEEAVVMEAPRPKSPPRYPDLCGRRRMQLEVQILSREITFLKDELHFLEGAQPVSRSGCIKEINEFVGTKHDPLIPTKRRRHRSCRLFRWIGSKLCICISCLCCCCKCSPKCKRPRCLNCSCSSCCDEPCCKPNCSACCAGSCCSPDCCSCCKPNCSCCKTPSCCKPNCSCSCPSCSSCCDTSCCKPSCTCFNIFSCFKSLYSCFKIPSCFKSQCNCSSPNCCTCTLPSCSCKGCACPSCGCNGCGCPSCGCNGCGCPSCGCNGCGLPSCGCNGCGSCSCAQCKPDCGSCSTNCCSCKPSCNGCCGEQCCRCADCFSCSCPRCSSCFNIFKCSCAGCCSSLCKCPCTTQCFSCQSSCCKRQPSCCKCQSSCCEGQPSCCEGHCCSLPKPSCPECSCGCVWSCKNCTEGCRCPRCRNPCCLSGCLC

SEQ ID NO: 90 - DNA, 661 bp, Zea mays
atggcagctgcggcggcgccgaggcccaagtcgccgcctgcctcgccggacccctgcggccgccaccgcctccagctcgccgtcgacgcgctccaccgggagatcggcttcctcgagggcgaaataagttccatcgagggggtccacgctgcctccagatgctgcaaagaggttgatgagttcgttggaaggaacccggatccgttcctaacgattcagcaagagagaggaagccacgatcaatctcagcagtttctgaagaagttccgaggaaagagctgcctgagctactacctctcgtggatctgcggtggcgggtggtggtgcccgccgccgttgcagctcaagaggccaccggcgccgagctgctcctgcgcgccgcggctggggaagctctgctcctccaccgcctcctcctgctgcagctgttgctgctgccggttccgcgtcgtgtacgccgccgccggctgcgggtgctgcgcgccgtgcccgcgctgctcgtgcgactgcacctgcgcctgcccgcgctgctgctcctgcgcctgccccatgtgcagmrccccrmgwgctgcgccccgcgctgctgcctgtgcctatgatggccatgagaaattttgcgtgcatgctagtagtagtagtacctggagatgatgatggatga

SEQ ID NO: 91 - DNA, 5889 bp, Zea mays
cttgctgtgctggctttgctggctcttgctctcccctcgccagcaataagctcggccccattccgcttctgccatcaagcccttgccgcgcgcgcacccgcgcactacgtataaccagctagagtagcttggtagctaggctcggctcgctagcgagctcgtcgatccaatccatcgctcgttcgtccactataacaatcgacgacgtgtacgatggcagctgcggcggcgccgaggcccaagtcgccgcctgcctcgccggacccctgcggccgccaccgcctccagctcgccgtcgacgcgctccaccgggagatcggcttcctcgaggtacactacagtacgcattaattaataaatactaatatataaacctcacctgcacatgctcgcataccaccacctctcatatcactccatcatcgattacgctgcactgctcggccgtcttcccgactgccgggcctttccgcattttaatttgcatgcatcacctatatgacaccatatcttatgagcaaggagccctgctgctcccatgagcaaaatcaatccagaccacaccctccacatccaacggtgctgcgtcaggggggttttgtaaaatgttcagagttgtaaagaacattttacaaaaccccctgacacagcaccgttggatgtggaggttgtggtctggattaattttgctcatgggagcaccaacgctccttgcgcacaagatacgttctctatatgttccttgctgctgagtcagatgcgcttccctttctctctctgtactgaaaatgcaatcgcatgcgtacgtgcagactgcacaaacaaaggatgacgaattgaggataacgaaattgaaattaccagttgcgctagctctggttggtggttctcgctcgatccggccggccgcgagagaaactgaaacgctagcgctagctagcactagcagcagtggggcgattcatgagaccgttaccttgaaagctagcttagtagttctttaatcctctgggcttgctggtttattagtttaggcctccgggcacgtgcggacccgtacgtacgtaccatggatttgcgcgcgtgtcaaggctcaacactctgcgctttatattcgttttgcctaccatttcccacgactacttactccgtcgtctccgtctctctactctatttagctagcttggattcttctttgtcttctgcctgccgctgatactacttctctctctctctctctcaagaatcaaagcactactactactgctgattcagttctgttctatatatctagctactagctagggtttaagggatctaggatctctacatgtacaagaagatacaaggccggcggcccacgctttgattattggtgtcacactgtcacatatgcatctcctagtcctaaatactcctctcgtatggcatgcatgcatggcttttaatacactatccgtatgatcgattacccgcaccatctcatcttatatcaccgcatttgttgattttacttaagattatgtttggttgtttgtatgtgtgagtcacggcctgcataggtggatgcaaaataagccattttgatgttactaaactgcatccacccatacgctcaaaattatcgtatctagccagtcaggacggtgtcagcctgcgcatggacgtgcatccatccaatcaggctgtataatacatcacctaaccgccttatctaggtactctagtatccacgtgtattaagatgaatcgagatgtgaattagtttaatttatacccccgcccccaatccacccccaatacatatggattggggtgaacactatagtacccaaacaaagctgtaggcgtaagtgcacaccttgcattgctggctacaccggcgcacactacactatagtagcaggcgcgtgtagtatatgctaaaacatattcccttcattttttattttgtcatggcttagttcaaaaataaactagcttacgataaatattcaagaacggagctagtatatatttaaacagcctaaatcaaggcttcctttagctcatcaatgaaaaactccgtgcaacctgccctttgctaactttattgttttaatgtattattattattgttgttgttgttgttgttattattattattattattattattattattattattattattattattattattattattattattactactattatttattattatctgaaacatagtcagcagggcatacgcgacataaagttgcttctgatctgatggtatagggaacgctccacatttgcaactactcatgctgtccagcagcctgctcactagctcagagctatgtcagctacccaagcaataaaatactcctgaaaacatacgttaattaaacactatttactgcccgatgagcatgcagaaacacagctagccctgcgttgccatcggtgtactgcatatatggcagagttattaattaatctaaaccgacaaattcatttagctctccgcaacgtactgatgatgttctacaacatactcatgcatgaccttactggctactgcaccagcagcttgcagcctatatgcatgtctttcttccttgatgcatacatagtcgtactccgcatggccgcatatataacgtacgagttcctttaggctattactagcagcttatccatcttcatctttttatatttaaacttcactcttccaacactacacagtctaccttgtaaaacagttttttagacgaccatacaagtgaattgttaaagactgtttaattttggcggtctattattaggacattagaatttttttgacgtgtcttcccttcgccttcggaaaaaatccctccgtttctttttatttgtcgctggatagtgctatttaacactattcagcgacaaataaaaagaaacggagggagtaccaccgtcgacgcctcaccaatcaccatggcatggcatgcaccacgtacgagacggtagaactttggtatgtagagcttcgttcacggtcacgcggtggtggagctccatcctgcagactttaaccatgcatgcccgtgagtccgtgacgaccttcttttccctctctctctctccccctactgctatcatggtcatggccatgggctcatggctaacctgcttcggctgtcttcttcaccgctctccccgtccccacaccgtctgacctgtccgttttttttaaaaaaataattaattaattaaagccgccaaatttgaagaagagaagaaggagaagatgagaagagagaaaaactgagtgccgaaagattcgatcggagtgagatgtagactttcggcagcatatagttataaccttaatgattaatctatcacgagattattgatatgccactatatatatgccggcgtacgtacggccgtctgtatataactatatagttgcactatctcgttacattagaataataatactgcaggaaaggccccaatgcaagctgggtttttttttcttcttcagcgagactccaaacttcgaaggtgccgcgtgtgttttaaaaatatcccagacaatgcctgaaaagttgacagctgaacacatggctttttacttgaccagtatacagtggtatttactatttaccaacatagtattactatatcattaccccctgaaacgctcggtttggtttccgttgctgcatgcagggcgaaataagttccatcgagggggtccacgctgcctccagatgctgcaaagagtaagctgaacacatgctccgttatatattatattgctacgtacgtgtgttatatacatacaggggggcggcccttgttacatttacatgcatgcgatccacgaggatggcttaaaacgctagtatcagaaataatcgatgaactttctctttagtttaattaattgcaaaacatgcatgttctcattcagttgtccatccatccatccatacattgttgttctttggataagatatatactagatagccatggtcggataactagctagttttaggtttctgtctgaatgaatcgctgctacaacaatatatatactgaccatgtgggcaaataaccaaagaagattctctgctgattgcctctctttgataattctctgcagggttgatgagttcgttggaaggaacccggatccgttcctaacgatgtatggattttcaggttgtgaattcgtcctttaacctagcgtgaatggtgccgttttcttaacatatatatctgttcaaaagcagtcagcaagagagaggaagccacgatcaatctcagcagtttctgaagaagttccggtacttccgttgctcacagctcttaataattattatagtaatcgccggttcttgcccattagtaaactacacgtctttattaatgttattttgttgtcaattgtgtattaccctagcactagctagcagatcgatcacatgaaaaaagactaatttgtacgagagaaaaaaaaatcctactatcatcacccaaatcatttttaggtaggatgggagaagcaacataaacaactagcctctgcaaatcgtcatatataagacagaaaactatcacccagagctaataaaccccgaaatgaatgagacatagatatctcaattattactgtctactgagaccacaacctgtccattttctgaaaaagtatgaaaagggggcatattcattcagtgcaagctgtatgaaagcttggtgatcatccgcgaacgagctgagcctcagtcccactccctcccaccagcgcgcgtacgtacgtgtacgtcctagcagcttcaacggcttgtatcagatctctgctgctttttttttacccctttgcagcctgcaacccgtactgcactactccctccgttcctttttatttgtcgctggatagtgtaattttgcactatccagcgacaaataaaaagaaacggagggagtacaaactttcagagtaatcagcatgtcgtctactttaaactgccatgccgtcaacatcacacgttgtcagcccagccctgcagagcaatcagtttgtcgttgtctgcgctaacacttaatcgagcatctatagtgctgcttttcagaaccgtcacctcattgttactataattgtttcaactatttcctcatcaccacgtcgtcagaaaaaccatcgtcgtctgctgctggctagctgaataggagtgcatcagtaaaacctgaaaataatgctgctgctactgtttgttgctaatgctagctagctactgcatagcttgcattgagttgggtgaattaatgattggcaatcagatgaatgaagttgagttttgtgcatgcatgcatgcagaggaaagagctgcctgagctactacctctcgtggatctgcggtggcgggtggtggtgcccgccgccgttgcagctcaagaggccaccggcgccgagctgctcctgcgcgccgcggctggggaagctctgctcctccaccgcctcctcctgctgcagctgttgctgctgccggttccgcgtcgtgtacgccgccgccggctgcgggtgctgcgcgccgtgcccgcgctgctcgtgcgactgcacctgcgcctgcccgcgctgctgctcctgcgcctgccccatgtgcagcgccgcgtgctgcgccccgcgctgctgcctgtgcctatgatggccatgagaaattttgcgtgcatgctagtagtagtagtacccggagatgatgatggatgactggcattttgcagcatggtttttttttttggtttagtttcggcgacacgagtactgttgtaactggctgtacgtggctgatctggttagtgctggtgaatggtgtcgattccacattttccgctgagagttgcca

SEQ ID NO: 92 - protein, 216 aa, Zea mays
  misc_feature (186)..(187): Xaa can be any naturally occurring amino acid
  misc_feature (189)..(189): Xaa can be any naturally occurring amino acid
MAAAAAPRPKSPPASPDPCGRHRLQLAVDALHREIGFLEGEISSIEGVHAASRCCKEVDEFVGRNPDPFLTIQQERGSHDQSQQFLKKFRGKSCLSYYLSWICGGGWWCPPPLQLKRPPAPSCSCAPRLGKLCSSTASSCCSCCCCRFRVVYAAAGCGCCAPCPRCSCDCTCACPRCCSCACPMCXXPXAAPRAAACAYDGHEKFCVHASSSSTWR

SEQ ID NO: 93 - DNA, 582 bp, Setaria italica
atggctgctgcgccggcggcacccaggcccaagtcgccgccggcctcgcccgacccgtgcggccgccaccgcctgcagctcgccgtcgacgcgctccaccgggagatcggcttcctcgagggtgaaataagttccattgacggggtccacgctgcctccagatgctgcaaagaggttgatgagtttgtgggaagaaatcccgatccattcataacgattcagccagagaaacgaagcaatgagcagtctcagcagtttctgaagaagttccgagccaagagctgcctgagctacctgtcgtggatctgctgcggcggcggcgggtgcccgccgttccagctgaagacgacgatgaggccgccgtcggcgagctgctcctgcggcggcgcgcggctgcggaagctctgctcgtccccgtgctgctgctgctgctgctgcaggtgccgcgtggtgtacgccgggtgctgcgcgccgtgcccgcgctgctcgtgcggctgcgcctgcccgcggtgctcgtcgtgcgcctgctgccccacctgcagcgacgcgtgctgcgccccgcgctgctgcctgtgcctatga

SEQ ID NO: 94 - DNA, 1185 bp, Setaria italica
ggcgtagtagtattccggaaaggcggaaacgaaggctcgcttggcgttggcgcagtctcccatctcccctccatcattgccgcccgaaacggcaacccgcccgccaccctctctccctcgctcctccatgtgcccgcctgcagctcgctccatcgccatttaatccgcctcgcctcgctgcttgctggctgcgcgtggcagcagcccggccggcggcagcttgctagtagcgctagctccatcatcattttcttcctcacagctccttgttcttattcactcgtcgcccgctcgccaagcaagccattcacctccagcaccgaacagcttcaccgtcagagtccggccgctcgattatatcggccggcggccgtcagtcagtcgccagcagaaagcaggaacgaaaaaaataatataatggctgctgcgccggcggcacccaggcccaagtcgccgccggcctcgcccgacccgtgcggccgccaccgcctgcagctcgccgtcgacgcgctccaccgggagatcggcttcctcgagggtgaaataagttccattgacggggtccacgctgcctccagatgctgcaaagaggttgatgagtttgtgggaagaaatcccgatccattcataacgattcagccagagaaacgaagcaatgagcagtctcagcagtttctgaagaagttccgagccaagagctgcctgagctacctgtcgtggatctgctgcggcggcggcgggtgcccgccgttccagctgaagacgacgatgaggccgccgtcggcgagctgctcctgcggcggcgcgcggctgcggaagctctgctcgtccccgtgctgctgctgctgctgctgcaggtgccgcgtggtgtacgccgggtgctgcgcgccgtgcccgcgctgctcgtgcggctgcgcctgcccgcggtgctcgtcgtgcgcctgctgccccacctgcagcgacgcgtgctgcgccccgcgctgctgcctgtgcctatgatggcgttgcgtatgatgcgcgcgtgctgctttaggatcgatgctgctacctgatcgatgaacgaagaagatgatggctttgatgcatggatgttggcagtttgcggtgtcgtctgacaatgcctggtcgtgctggcgaattgagtcaacttattatttcggcccggggtcgcgatttttttcaaaa

SEQ ID NO: 95 - protein, 193 aa, Setaria italica
MAAAPAAPRPKSPPASPDPCGRHRLQLAVDALHREIGFLEGEISSIDGVHAASRCCKEVDEFVGRNPDPFITIQPEKRSNEQSQQFLKKFRAKSCLSYLSWICCGGGGCPPFQLKTTMRPPSASCSCGGARLRKLCSSPCCCCCCCRCRVVYAGCCAPCPRCSCGCACPRCSSCACCPTCSDACCAPRCCLCL

SEQ ID NO: 96 - DNA, 601 bp, Brachypodium distachyon
ccatccatccattgcccgcttctcctctcctcaacatccaatcgatccatccatgggcgcccgtgccactagctactagagcgtccatcggacaaagcccatatcgatgatggcaatggtggcgcccaggcccaagtcgccgccggcctcgccggacccctgcggccgacaccacctgcagctcgccgtcgacacgctccaccgcgagatcggattcctcgagggggaaattagttccgttgaaggggtgcatgctgcctccaaatgctgcaaagaggttgatgagttcgtaggaaagaatgccgatccattcataacgatttcatcaaagaaggcgaacaccgatcagtctcgccaccttccaaagaagtttcgagcccggacgtgtttgagctacctgtcgtggatgtgctgctgcggcgggtgtccttccgtccagctccaggggccaacgagctgctgctcttgcggagcgctgggagggctgtgcggttgctgcagcaccggagaatgctgccgctgccgcgtcgggtgcgggggctgcggctgctgctgctgctgctgccgtggcagcccaaataacacgacgaagctcacttag

SEQ ID NO: 97 - DNA, 3290 bp, Brachypodium distachyon
ccatccatccattgcccgcttctcctctcctcaacatccaatcgatccatccatgggcgcccgtgccactagctactagagcgtccatcggacaaagcccatatcgatgatggcaatggtggcgcccaggcccaagtcgccgccggcctcgccggacccctgcggccgacaccacctgcagctcgccgtcgacacgctccaccgcgagatcggattcctcgaggtaacattaccagttaatttaccactgctcttctcgactcgcatattatgaggccgcccatattatgtgtacgaaaaatccgaaatagattaactcataccatcccttctactatagtgctagctcactactgtaccaaaactggatcaaccaaaattaataagggtcaacaaaatgacatgaagcacgcagccagtcgccggagatcaggcaagcactactacttcgagagagactgagtagtagttaatactagctagctggagtttgaacagctcgaagattagtttagtcggctagctacctctgggcacgtgcggatcgtaccatcgatttgcgcatgtttaaggcaaagtctctgtctgaattattccctttgcttttgaacgttggagggttctctagataggaccatgggatactcgatctgatcaatgcggtttgctggttgttctagggttttagttaggggtttactgggcgcaagccaccgatttttttttctgggggaaactaactgtttatcttgtatatgtactatggtctatgtgtaggcatggggtattttccgtggctttttgttagtgtttttggagactattcgaaaccatttggttggaataatccggagtgctacggatggcttaagctgaaaaaggatatttttatttatttattgagtatttgcatatatgtctattcagtaccctctttttttttggaaaaagaaacccaaccattgtcatgaaagtaaattccaaagccttagccttacgcatatgcgtatttatgatgcaagcagatgcgacagttttctaactcttcctggctaggtcctgtccgacctgttcattgggagtatttaaatattctgggagggatctgtttttgcggcagttatggacagaagagctagcaaaatcacactgccactagctctctgttacagaatatatggttcaactttgcactagccaaatgatgttgtgtgaaaagttaattggcatgcttaataggagtataatatttggtacgaataaacagtactaactaaattttaggtatctagggtagcatagtgctgggtctagaaatttagagtgataatctttattttataaaagacgtaataattggtggcaaccgtcggtcacattcggttctgtcacttgttccacttgttgatttttggatatggattatatgatccaaggtaatgcatatgacaatatgaaattttatttaaacacataatgtattttttattcctggcaacaacacaacttaggagcattgacctaataactatatgtaactaacaaagtattttctccaattctaaatttttgtcgttgttttagtttaaatttgaattaaaaacaacataagaatttagaatcaaggggaatagagtcaaagtcctacagtccgattagctttaaacgtttggaatgttaaaatattggacatcacatgaaaagttgacaggctcgtcagatgaccttttcctccatgtatactatgctagctagtgctttgaataattttttttcctgacatacttgaactaattcaacaaataattattttcctcgtagggggaaattagttccgttgaaggggtgcatgctgcctccaaatgctgcaaagagtaagctgcgtttctggtttcaattcttataccgtttcttcttctgcctttttgtttttataatggaaatatatgcagcaaaggagtttaatttctacacatgtacgattccacaacatcattattccaagtttgacaattagtactttactagatatgcagtacaagtttcaggataattggaaaaaatctgaattaaaaataaataaaaatatgcttagttttcatagcatatgacctccagtcaaacgtacttagatgttaatcagatcatgcatgtgtgcaaagtattcagaaagtccatttgtcaaactaactttttcacatggacatgtgcaaaagaaagcgtttacctagctaggtttgataattcagtcaggtcattttattctcgagataaaacacatggagaaaatcgatcattgatttgataacaattttttgcagggttgatgagttcgtaggaaagaatgccgatccattcataacgatgtatggattttcaggttgataagttgtctcccgcttcacatacatgatactattttgcttattatctctctctctttacaaagcagttcatcaaagaaggcgaacaccgatcagtctcgccaccttccaaagaagtttcggtacttattttcttcccggctcttaactcacgtccgacacctagcaaatgcatagttcaccaacggagggcaaacgttgtgtgtatgcagagcccggacgtgtttgagctacctgtcgtggatgtgctgctgcggcgggtgtccttccgtccagctccaggggccaacgagctgctgctcttgcggagcgctgggagggctgtgcggttgctgcagcaccggagaatgctgccgctgccgcgtcgggtgcgggggctgcggctgctgctgctgctgctgccgtggcagcccgtgccgcagccgcacgccgagcccgagatgctcgtgtggttgcacgtgctcctgcccgagctgctgctcctcctcttgcgcgtgtccggctccctcctgctgccgtgcccctcggtgttgttacctgtgttcatgaggtggattgatctttgttgtcagtaccgtgtgcgtgcttgctgttgtgggatgtacgctcagctggtgttatgttttttttacgggattgatgatggtatatttgccgtgctcctggcttagttttttattttttttcgcgaggaagaggtgagctttattattcaataataggattacagtcagcagcaacagctaccatgacgttaggatggggctgattcaacagaacatcatctgatcctctagcccttctccccaagtttgctaacaaatctgcaaccctattttgtgaacaattaatcttcttgataacaagctcacgatctccagaaataacacgacgaagctcacttag

SEQ ID NO: 98 - protein, 164 aa, Brachypodium distachyon
MMAMVAPRPKSPPASPDPCGRHHLQLAVDTLHREIGFLEGEISSVEGVHAASKCCKEVDEFVGKNADPFITISSKKANTDQSRHLPKKFRARTCLSYLSWMCCCGGCPSVQLQGPTSCCSCGALGGLCGCCSTGECCRCRVGCGGCGCCCCCCRGSPNNTTKLT

SEQ ID NO: 99 - DNA, 1131 bp, Sorghum bicolor
gctactcctagctccctcctccatcattattccggcctgcaagcacacttgctcttgctcgatcattaattagttcgtcgctcgatcgatccctcgccctgcacgcagcaagccccgcccattctgctaccttctgcctgcgcatgcatctccctctcttccttcaattcatcagcaaagccttgccgcgcgccgcgtgcgtaacgtaccagctgctagtagtgcactagtgctacgccgccgccggctctctcgtcgtcgtcgtcgttgacgatcgtcgttcgtccagtatatatatatatatacaccaattaataggatcggataagaagaagaagctactagctagaacagataatggcggcggcgccgaggcccaagtcgccgcctgcctcgccggacccctgcggccgccaccgcctccagctcgccgtcgacgcgctccaccgggagatcagcttcctcgagggcgaaataagttccattgagggggtccacgctgcctccagatgctgcaaagaggttgatgagtttgttggaagtaatccggatccattcctaacgattcagccagagaaaggaagccatgatcaatctcagcagtttctgaagaagttccgagcaaagagctgcctgagctactacctctcgtggatctgctgctgcggcggtggcggtggcggtggcagtggcgggtggtgcccgccgtcgctgcagctcaagaggccagcggcgccgagctgctcctgcgcgccgcggctgaggaagctctgctgctgctgttgctgctgccggtgccgcgtggtgtacgccggcggcgccggcggctgcgggtgctgcgcgccgtgcccgcgctgctcgtgcgactgcacctgcgcctgcccgcgctgctgctcctgccccaggtgcagcgccgcgtgctgctgcgccccgcgctgctgcctgtgcctatgatggccacatgagaaattttgtgtgcatgctactacccggagaaccgtggttttgatgatggatgactggcattttgcagcatgttttttttttgtttagtgtcggcgacacgagtactattgctaacttgctgttctggttcgtgctgcatgctgattgctgaatggtgtcgattcc

SEQ ID NO: 100 - DNA, 4951 bp, Sorghum bicolor
gctactcctagctccctcctccatcattattccggcctgcaagcacacttgctcttgctcgatcattaattagttcgtcgctcgatcgatccctcgccctgcacgcagcaagccccgcccattctgctaccttctgcctgcgcatgcatctccctctcttccttcaattcatcagcaaagccttgccgcgcgccgcgtgcgtaacgtaccagctgctagtagtgcactagtgctacgccgccgccggctctctcgtcgtcgtcgtcgttgacgatcgtcgttcgtccagtatatatatatatatacaccaattaataggatcggataagaagaagaagctactagctagaacagataatggcggcggcgccgaggcccaagtcgccgcctgcctcgccggacccctgcggccgccaccgcctccagctcgccgtcgacgcgctccaccgggagatcagcttcctcgaggtatgtatgtatgtatgtatgtacggatcactcaatactagctaagctagctagctaccacctgcatgccattcttcgattctagctcgcatatatattatgctgcagtgctcgaccgatctttgcagtttgcatcacctacctatcctcttgctgccttgctcagctgcgtttgccattttccttctctctctctctctctctctctctcttatgtgtttcaaaaatgcatatataaacaatcgcattcagaaaatgatatacaaggataaataaagtgtgcgtagtcaacgaagttcaaatttaccagttgctggtggctcctctccatatgggccggccggccgagaactgaaacgctatcagcagtagtagatgacaccgtttaactttgaaagcttaattagtttaatccatcctagctgtgctaatggtcagcagtttaatctctctctgcctctgggcacgtgcggatcgtaccatggatttgcgcgcgtgtcaagcctcaactctgctctttatattccgtttgcctaccatttttttcccacgattccgactcgtctcagagcttggattcttcttctcttctaacctgctgatgatgatattatactacgggcgtgtttagatccaaaatttttttggattttgacattgtagcactttcgtttttatttaacaaacattgttcaatcatggagtaactaggtttaaaagattcgtctcgcgatttacagacaaactgtgtaattagtttttatttttatctatatttaatacttcatacatgtgccgcaagattcgatgtgatggggaatcttgtaaagttttgggtttttgagtgtatctaaacaaggcctacattacttctctcacacacacaatctcaaataaagcactattactactactactaatgatttttttttgtctatctatcgatctggctagggtttaagggatctaggatctagtacatggaagaagatacaagggccggcccacgctttgattattgcctttgtgtcacctgcgtatatcctaaatactactccgatcctatatcctatcatatggcttggaggctttcactacaataatataatactacacccatgtaggcgtcagtgtgtcactataatgctacattagcgctaaaccatagcagctgtacttgcgaaaacatgtttcagatcagcaggctcttcctccttcaaggcttcaactcatcatgaaaaatttcgtccagcccggcctggcctttgcttgccggacaccttctcgttttaatgccttgttattatttatgttatatctgaaataatatatcagcagcacgcatactggacataaagttgcttctcatggtgccacatttccaactactcatccctgtccagcagcctgctcactcatcacttcatcagagctcagctacccagcaataaaatattcccgaaaacagatgttaattgaacactattatttactgcccgatgagcctgcaaaaacacagccctgcattggtgccatgcctacgtgccatctcggtatgtaagagttaattaatcttaactgacaaatttattcaaatactccacaactgatggttctacttcaaactgatcatgacctactaggctaccacaccagcttgtgtgtatgcgaatgcatggcttccttccttgatgcatatagtacctccccccccttacataataaccttaggccttgtttagtttctaaaaatttttaaggttctccgtcacattgaatcttgcggcacatgcatgaagcattatatatagacgaaaataaaaactaattacacaatttgcctgtaaatcgtgagacgaatcttttgaccctagttagtctatgattggacaatatttgccacaaacaaacgaaagtgctacagtagcgaaatccaaaaaatttcgcgaactgaaccaggccttattaatttgttacaagattgtttgtttcttctgttccaacacagcaacgaagcattatatcaaaaaaaaaaacgacgttgcattgatgccaaaatatgctggcgtacggccgtttgcatatggttgcagactgcagtatctcgttctattagaatattggaaagctcggcccccagctggggttttcttcagtaaactcaaactttgaatgtgctgtgtgttaaaaatatcccagacgacaacgcctgaaaagttgacagctgaacacatggcttttacttaccagcagtatacagtagtatttactattaccaatatgatattattatattatatatcctgaaacgctcgatttaatttctttgctgcagggcgaaataagttccattgagggggtccacgctgcctccagatgctgcaaagagtaagctcaacaaatactccattattactactttgtgtacaggggaccttattacttgcagtgttttcacaagaatggctgaaaatgctagtatcagaaaataattcatgaacttaatttctctttaatttaaactgcaaaacatattctcatccaaatgtccatgcatccatccattgttcttcggaatagatactggataactatggttggataactagttttataggtttctatatgagtaaattgaattgcttctctatatattgaccgatgaccatgtggatcgtcggagaaaccaaagatgattctctgttgattgcctctctttaataaatctttgcagggttgatgagtttgttggaagtaatccggatccattcctaacgatgtatgaattttcaggttgtgaatttgtctttaacttagcatgaatgctgcatttttcttattatctctttttaaaaagcagtcagccagagaaaggaagccatgatcaatctcagcagtttctgaagaagttccggtacttcctttgctcctcacaactcttaatattgttggttcttaccattaccagtagcacacgcgcgcatatatagtaatgttattttgttgtacgagaaaaattctaccatcattatctcctaataataatcctaaaatcattgttaggtaggagaatgtacacagaaagataacagtctctgtatatcgtcacaagacataaaactaacaccagccttgtttacttctacccaaaaacctaaaattttttaagattctccgtcacgtcgaatctttagacgcatgcatgtaatattaaatatagacgaaaataaaaactaattacatagttaggtcagaatttacgagacgaatcttttgagtctagttagtccataattagacaataattaccacaaacaaacgaaagtgttacagtgtcgtgaaatctttcccatgaggaactaaacacggcctaaaactgaaatgaatgacacatatatctctccattattactgtctactgtcctattgagaacacaacctgtccattttctgaaaagtatgcaagtgcatattcattcagttcaagctgtatgaagtttgtgatcatctgcgagcctcagtcccaccagcgtacgttctagcagcttcaacggctcgtatcagatctttgctgtttttttcctctgcagcagcctgcacccctccactgtactactgcactacaaactttcagagcaattaccttgtcgtttactactttaaactgccatgccatcaacatcacattatcagccagagcaatcagtttgtcgatcgttgtctgcactaacacttaattgagcatctaaagagctacttttcagaaccgtcacctcattgttactataattgtttcaattattcctcaacatgccgtcagaaaccatcagctactgaatatgtccgtcagtaaaccatgaaatgatgctgctgtttgttgctagctagctagcttgcattgggtttttgggtgaatgattgacaatcgatcacggagcagatgaagttgcttactcttgtgcatgcatgcagagcaaagagctgcctgagctactacctctcgtggatctgctgctgcggcggtggcggtggcggtggcagtggcgggtggtgcccgccgtcgctgcagctcaagaggccagcggcgccgagctgctcctgcgcgccgcggctgaggaagctctgctgctgctgttgctgctgccggtgccgcgtggtgtacgccggcggcgccggcggctgcgggtgctgcgcgccgtgcccgcgctgctcgtgcgactgcacctgcgcctgcccgcgctgctgctcctgccccaggtgcagcgccgcgtgctgctgcgccccgcgctgctgcctgtgcctatgatggccacatgagaaattttgtgtgcatgctactacccggagaaccgtggttttgatgatggatgactggcattttgcagcatgttttttttttgtttagtgtcggcgacacgagtactattgctaacttgctgttctggttcgtgctgcatgctgattgctgaatggtgtcgattcc

SEQ ID NO: 101 - protein, 198 aa, Sorghum bicolor
MAAAPRPKSPPASPDPCGRHRLQLAVDALHREISFLEGEISSIEGVHAASRCCKEVDEFVGSNPDPFLTIQPEKGSHDQSQQFLKKFRAKSCLSYYLSWICCCGGGGGGGSGGWCPPSLQLKRPAAPSCSCAPRLRKLCCCCCCCRCRVVYAGGAGGCGCCAPCPRCSCDCTCACPRCCSCPRCSAACCCAPRCCLCL

SEQ ID NO: 102 - DNA, 354 bp, Aegilops tauschii
atggcggcgcccaggcccaagtccccgctcgacccctgcggccgccaccggctgcagctcgccgtcgacgcgctccaccgccagatcagcttcctcgagaacccggtgggcgtgtttgagctgcttcccgtggatctgcggcggcgggtgctccgccgtccagctcaaggggccgagctgctgctgcggatgcccccggtgctgcgtggggagcgggggctgcggcggcgggccctcttggagaaggaggatccaaagctagtgtccgcccagaagatcaactcggcgacccacaacgcgtgccaccacgtcgaaaggtgcaaggagatggtggctttggcgagcgaggactaa

SEQ ID NO: 103 - DNA, 3048 bp, Aegilops tauschii
  misc_feature (2294)..(2433): n is a, c, g, or t
atggcggcgcccaggcccaagtccccgctcgacccctgcggccgccaccggctgcagctcgccgtcgacgcgctccaccgccagatcagcttcctcgaggtaaccaagctcctgaccttaatcgctcttcctggttggctcccgcactactgccatgataaatgatgccctgctgttactctgttattccgcaagaaaaattacagtactaattagcagctgagcatgtacaaatgatcgccatttctttataggtatgagtactctattataggtatctaaagtccgctaccaacacacagtttggttgtcacttctaagtcagttccaagtgttcttttctactactactagattctagagtaagtgttaaaatatccccccagtttagcagtaagcatacaaaaatgatcagcatttctttataggttggttgccaacacacggtttggttgtcacttcccagtcaattccaggtgttcctttctagtactccctccattccaaattagtcgtcgtggttttagttcaaatttaaactaaaaccacgacgagtaatttggaacggtgggagtagtagtagattccaagtgttgttaaaatatcccagacagcagcctgaaaagttgacacatgccctctcctccttgtactgtattgctagtagctatactagctagtagctactgctttttttcaataaaaaaatcatttctatggaattcaagaaactgttcttctgtgccagggggagatcagttccattgaagggctccatgctgcctccatatgctgcaaagagtaagctgctgtcttgttcaattcttatactatcaatttcctttttgaaatttaagaggtaacttagggagcgaaaacaagaaatagttctccggctccaaaaatgggaaacaatccattacatgtgagcccatgttttaagaaagttgtacagatacgtgcaacacttctacatggatatgtgaaggcaacacagattttagttaaaacctctaaatagaagtttcgcgttttagccaagaaatgtcgctctcagtggagatttatacaataatactccctccgtcccaaaattcttgtcttagatttgtctaaatacagatgtatcaagtcacgttttagtattagatacatccgtatctagactaatctaagacaagaattttgggacggagggagtagattactatctacgaccatgggcttccacaccaatgattgaaaatagtatacacttacaactgaacattatgcaaatccagtagcaatagtttgggagatttggttagttgaaatttgattaggatgattgattgtatttaaatacgtgaatatgttttggaattggacttaaattacatagggttgcggtgtgcttttattttcatctccagtcttggtgccacttattacttgattcttcataaatgaatatcagtgtaagctgcatacgtagcagtcagatcatgcgtgcaaaaggcaaaaatatgtaattcttcatgtgtcaatcagttcacacaattgtgccaattttaagttaattttcttcttattcatgacatatggaggtgattgatcgtcgtttgcccctttgataaaatttgcagggtcgatgagttcataggaaagaatgccgatccattcatcacgatgtatggattttcaggttgagaaattgtcttggcctacaagatatctttgttcttactagtatctctctttacaagcttgcagttcatctgagaagggaaatgccgatcaatctcatcgcttcccaaagaagattcggtaatcatttcctccctgcagatcttaatatatgttgatggttgtcttgaaagaaaatgacgccggatcaacccaagctgatgcaaattgttatcctaaactgcacttgaagcatttaaaagtttgaaatattgctaattttccggtttttacatctgcactctacaaaccttaacaattatttgtcagccagtaatgcatgcatcgatttgaactcgtttttagttagccgttgtaatgaactgaccgagggggatgttaatgtttgtgtctgcagaacccggtgggcgtgtttgagctgcttcccgtggatctgcggcggcgggtgctccgccgtccagctcaaggggccgagctgctgctgcggatgcccccggtgctgcgtggggagcgggggctgcggcggcgggccctcgtgtggctgctcatgctcctgcgccggttgctcctcctcttgcgcgtgccctgcctgtaccggctggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgccctcgctgctgcctgtgttcatgaggcgccctattgagatttttcctcttctttgttcttgctgtgtgcgttgcctgtaggctcaggctcggctggtgtttttgacgggcatgatgatgatgatgtatttctggctcagttggcgctgtggatttgcctggttttacttgccacagcgatggatcccttgtgctttcgtccttgctatggtctcctatgttgtaattaaagctttggagataactgcagaatgaacggttcttctcactgatgatggttagggtgtattacccggttagagcatctttagctgatcctgtaaaaaaggcctcggcccttataataactgccggtttcggtttttgtaaaaagaaaaaaaaaatgacccgagcacattcccaccccctccagctgattgtcgccgccctccacccatgttcccgcccttatcgccgtcggccgccacatggattggtgtgtaccattgccggagttggagaaggaggatccaaagctagtgtccgcccagaagatcaactcggcgacccacaacgcgtgccaccacgtcgaaaggtgcaaggagatggtggctttggcgagcgaggactaa

SEQ ID NO: 104 - protein, 117 aa, Aegilops tauschii
MAAPRPKSPLDPCGRHRLQLAVDALHRQISFLENPVGVFELLPVDLRRRVLRRPAQGAELLLRMPPVLRGERGLRRRALLEKEDPKLVSAQKINSATHNACHHVERCKEMVALASED

SEQ ID NO: 105 - DNA, 426 bp, Triticum urartu
atggcggcgcccaggcccaagtccccgctcgacccctgcggccgccaccgcctgcagctcgccgtcgacgcgctccaccgccagatcagcttcctcgagggggagatcaattccattgaagggctccatgctgcctccatatgctgcaaagagaacccggtgggcgtgtttgagctgcttcccgtggatctgcggcggtgggtgctccgccgtccagctcaaggggccgagctgctgctgcggatgcccccggcccagtctcaggctcagctggtgtttttgacgggcatgatcatgtcgtatttctggctcagttggcgctgtggatttgcgttttacttgccacggagatggatcacttgtgctttcgttcttgctatagtctcctacgttttaattaaagctttagagataactgcagaatga

SEQ ID NO: 106 - DNA, 2815 bp, Triticum urartu
  misc_feature (1870)..(2528): n is a, c, g, or t
atggcggcgcccaggcccaagtccccgctcgacccctgcggccgccaccgcctgcagctcgccgtcgacgcgctccaccgccagatcagcttcctcgaggtaactaagctcctaatcccgactgactcgcacaatataccctgtaaagatgatgctctgctgttactctgttatcacgcaagaaaaattactgactagcagttgagcatacacaaatgatcaccatttctttacaggtgtctaggctctagagtctgttaccagcacacagtttagttgtcacttccaacttctaagtcaattccaagtgttcctttctgctactactgctactagattcttagtgttaaaatatcccagacagcaacctgaaaagttgacacatgcccttttctccctgtactatattgctagttgctagctagtagctactgctttttttcagtaaaaaataatttctctggaattcaagaaactattcttatgtgccagggggagatcaattccattgaagggctccatgctgcctccatatgctgcaaagagtaagctgctgtgtttgttcagttcttatatcagttttgtttttgaaatttaagagataaggtagggaacgaaaacaagaaatagttctccggctgcaagaatggagaacaatccattacaagtgagcccatgtttgaataaagtcgtacagatgcgtgcaacacatctacatggatgtgtgaaggcaacacaggttttagttaaaacctctaaatggaggtttcacattttagccaagaaatgtcgctctcagtggaaacttgtacaatacattgctatctactaccatgggcttccacaccaatgattgaaaatagtatacacttacaactgaacattatgcaaatctggtagcaatagtttgggaggtttgattacttggaatttgattaggatgattgattgtatttagatatatgaatatgttttggaactggacttcaattatatatggttgcgttgtacaggcagtgcttttattttcatctccagtctcagtgccactgattactttattcttcttcataaatgaatatcagggtaagttacaaacgtagcagtcagatcatttgtgcaaaaggcaaaaatatgtaattcttcttcatatgtcaatcagttcacacattgtgccagttttaagttaattttcttcttgttcatgacaaatggaggtgattgatcgtcgtttgcccctttgataaaatttgcagggtcgatgagttcataggaaagaatgccgatccattcataacgatgtatggattttcaggttgagaaattgtcatggcctacaagatatctttgttcttactagtatctctctttacaagcttgcagttcatctgagaagggaaacgccgagcaatctcatcccttcccaaagaagatccggtaatcattttcttcccgcagatcttaatatatgttgatgggtcactggaaagaaaatgctgccagatcaacccaagctgattcaaattgttgtactaaacttcatatgtttatatttaaagcatttagaagtttgaaatattgctagttttcccatttttacatctgcactctgcaaaccttgacaattatgaatcagccagtaattcgtgcatcgatttgaactcgtttttcatcagtcattgtaatgaactgactgagggggatgttaatgtctgtgtctgcagaacccggtgggcgtgtttgagctgcttcccgtggatctgcggcggtgggtgctccgccgtccagctcaaggggccgagctgctgctgcggatgcccccggtgctgcgcggggagcgggggctgcagcgggggggccccgcgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggctccgtgtgctgcggcggcgtccctcgccctcgctgctgcctgtgttcatgaggcgccgaattgagatttttcttcttcattgttcttgctgtgtgcgttgcctgtaggcccagtctcaggctcagctggtgtttttgacgggcatgatcatgtcgtatttctggctcagttggcgctgtggatttgcgttttacttgccacggagatggatcacttgtgctttcgttcttgctatagtctcctacgttttaattaaagctttagagataactgcagaatga

SEQ ID NO: 107 - protein, 141 aa, Triticum urartu
MAAPRPKSPLDPCGRHRLQLAVDALHRQISFLEGEINSIEGLHAASICCKENPVGVFELLPVDLRRWVLRRPAQGAELLLRMPPAQSQAQLVFLTGMIMSYFWLSWRCGFAFYLPRRWITCAFVLAIVSYVLIKALEITAE

SEQ ID NO: 108 - DNA, 255 bp, Triticum aestivum
atggcggcgcccaggcccaagtccccgctcgacccctgcggccgccaccggctgcagctcgccgtcgacacgctccaccgccagatcagcttcctcgagggggagatcagttccattgaagggctccatgctgcctccatatgctgcaaagaggtcgatgagttcataggaaagaatgccgatccattcatcacgatttcatctgagaagggaaatgccgatcaatctcatcgcttcccaaagaagattcggtaa

SEQ ID NO: 109 - DNA, 1826 bp, Triticum aestivum
gccggcaatggcggcgcccaggcccaagtccccgctcgacccctgcggccgccaccggctgcagctcgccgtcgacacgctccaccgccagatcagcttcctcgaggtaaccaagctcctgaccttaatcgctcttcctggttggctcccgcactactgccatgataaatgatgccctgctgttactctgttattccgcaagaaaaattacagtactaattagcagctgagcatgtacaaatgatcgccatttctttataggtatgagtactctattataggtatctaaagtccgctaccaacacacagtttggttgtcacttctaagtcagttccaagtgttcttttctactactactagattctagagtaagtgttaaaatatccccccagtttagcagtaagcatacaaaaatgatcagcatttctttataggttggttgccaacacacggtttggttgtcacttctcagtcaattccaggtgttcctttctagtactccctccgttccaaattagtcgtcgtggttttagttcaaattaaaactaaaaccacgacgagtaatttggaacggtgggagtagtagtagattccaagtgttgttaaaatatcccagacagcagcctgaaaagttgacacatgccctctcctccttgtactgtattgctagtagctatactagctagtagctactgctttttttcaataaaaaaaatcatttctatggaattcaagaaactgttcttctgtgccagggggagatcagttccattgaagggctccatgctgcctccatatgctgcaaagagtaagccgctgtcttgttcaattcttatactatcaatttcctttttgaaatttaagaggtaacttagggagcgaaaacaagaaatagttctccggctccaagaatggaaaacaatccatggcaagtgagcccatgtttccatagagttgtacagatgcgtgcaagacatcaacatggatgtgtgaaggcaacacagattttagttaaaacctctaaatagaagtttcgcgttttagccaagaaatgtcgctctcagtggagatttatacaataatactccctccgtcccaaaattcttgtcttagatttgtctaaatacagatgtatcaagtcacgttttagtattagatacatccgtatctagactaatctaagacaagaattttgggacggagggagtagattactatctacgaccatgggcttccacaccaatgattgaaaatagtatacacttacaactgaacattatgcaaatccggtagcaatagtttgggagatttggttagttgaaatttgattaggatgattgattgtatttaaatacgtgaatatgttttggaattggacttaaattacatagggttgcggtgtgcttttattttcatctccagtcttggtgccacttattactttattcttcttcataaatgaatatcagtgtaagttacaaacgtagcagtcagatcatttgtgcaaaaggcaaaaatatgtaattcttcttcatatgtcaatcagttcacacatcgtgccagttttaagttaattttcttcttgttcatgacaaatggaggtgattgatcgtcgtttgcccctttgataaaatttgcagggtcgatgagttcataggaaagaatgccgatccattcatcacgatgtatggattttcaggttgagaaattgtcttggcctacaagatatctttgttcttactagtatctctctttacaagcttgcagttcatctgagaagggaaatgccgatcaatctcatcgcttcccaaagaagattcggtaa

SEQ ID NO: 110 - protein, 84 aa, Triticum aestivum
MAAPRPKSPLDPCGRHRLQLAVDTLHRQISFLEGEISSIEGLHAASICCKEVDEFIGKNADPFITISSEKGNADQSHRFPKKIR

SEQ ID NO: 111 - DNA, 699 bp, Oryza sativa Japonica Group; identical to SEQ ID NO: 5

SEQ ID NO: 112 - DNA, 5609 bp, Oryza sativa Japonica Group; identical to SEQ ID NO: 6

SEQ ID NO: 113 - protein, 232 aa, Oryza sativa Japonica Group; identical to SEQ ID NO: 7

SEQ ID NO: 114 - protein, 28 aa, Artificial Sequence
  Protein domain
ALRPQDSPGHRRASSVIAKLMGLEEAPN

SEQ ID NO: 115 - protein, 30 aa, Artificial Sequence
  Protein domain
IEDWSFDSESPSTVLEIERLIYKDLIDEVI

SEQ ID NO: 116 - protein, 24 aa, Artificial Sequence
  Protein domain
SLENAPSPISVLDTSYYHTRLSYS

SEQ ID NO: 117 - protein, 20 aa, Artificial Sequence
  Protein domain
KLHRRIVFDLVNEITAQKMN

SEQ ID NO: 118 - protein, 27 aa, Artificial Sequence
  Protein domain
ELERQMGCMAGIFQIFDRRQRLLTARR

SEQ ID NO: 119 - DNA, 22 bp, Artificial Sequence
  Primer
gcttatttcaaccccccctctc

SEQ ID NO: 120 - DNA, 21 bp, Artificial Sequence
  Primer
gacgcgtgagatgagatgtgg

SEQ ID NO: 121 - DNA, 21 bp, Artificial Sequence
  Primer
ccacatctcatctcacgcgtc

SEQ ID NO: 122 - DNA, 21 bp, Artificial Sequence
  Primer
catccaactgcagagcagctc

SEQ ID NO: 123 - protein, 62 aa, Artificial Sequence
  Protein domain
PAPPDPPCGRHRLQLAVDALHREIGFLEGEINSIEGIHAASRCCREVDEFIGRTTNFRNGFR

SEQ ID NO: 124 - protein, 41 aa, Artificial Sequence
  Protein domain
CSSSSSSSFNLKRPSCCCNCNCNCCSSSSSSCGAALTKSPC

SEQ ID NO: 125 - protein, 55 aa, Artificial Sequence
  Protein domain
CASCSCSPPCACCAPPCAGCSCRCTCPCPCPGGCSCACPACRCCCGVPRCCPPCL

SEQ ID NO: 126 - protein, 20 aa, Artificial Sequence
  Protein domain
ASACCLSYLSWICCCSSAAG

SEQ ID NO: 127 - DNA, 20 bp, Artificial Sequence
  Primer
aagcatgacagctgcaagac

SEQ ID NO: 128 - DNA, 20 bp, Artificial Sequence
  Primer
ggggatgaagggtaatttcg

SEQ ID NO: 129 - DNA, 20 bp, Artificial Sequence
  Primer
tacatacacgttcatgtgcc

SEQ ID NO: 130 - DNA, 19 bp, Artificial Sequence
  Primer
cgagcgtaggaagactacc

SEQ ID NO: 131 - DNA, 19 bp, Artificial Sequence
  Primer
cagcaaaccaaaccaagcc

SEQ ID NO: 132 - DNA, 20 bp, Artificial Sequence
  Primer
gcgaggaggaggagaaaaag

SEQ ID NO: 133 - DNA, 19 bp, Artificial Sequence
  Primer
cagcaaaccaaaccaagcc

SEQ ID NO: 134 - DNA, 20 bp, Artificial Sequence
  Primer
gcgaggaggaggagaaaaag

SEQ ID NO: 135 - DNA, 18 bp, Artificial Sequence
  Primer
tgttaattccgtgtccga

SEQ ID NO: 136 - DNA, 22 bp, Artificial Sequence
  Primer
tgaaaatcaaatttgttacggt

SEQ ID NO: 137 - DNA, 20 bp, Artificial Sequence
  Primer
gagtttgggtgtagcttcca

SEQ ID NO: 138 - DNA, 20 bp, Artificial Sequence
  Primer
tctgaactcggccaaagtag

SEQ ID NO: 139 - DNA, 20 bp, Artificial Sequence
  Primer
ggctctacctcgctgttgtc

SEQ ID NO: 140 - DNA, 20 bp, Artificial Sequence
  Primer
acgaatataacctgcggcag

SEQ ID NO: 141 - DNA, 22 bp, Artificial Sequence
  Primer
catttcaactagtaagcgtgtc

SEQ ID NO: 142 - DNA, 20 bp, Artificial Sequence
  Primer
ttacagccgctatgataagg

SEQ ID NO: 143 - DNA, 21 bp, Artificial Sequence
  Primer
agcccaccgtataccaagtct

SEQ ID NO: 144 - DNA, 22 bp, Artificial Sequence
  Primer
atccatagatgttctcttgtcc

SEQ ID NO: 145 - DNA, 21 bp, Artificial Sequence
  Primer
tggacaaagagggagatagca

SEQ ID NO: 146 - DNA, 20 bp, Artificial Sequence
  Primer
tccctatcctgtccgacatc

SEQ ID NO: 147 - DNA, 20 bp, Artificial Sequence
  Primer
tggatgcaatgtgaccaaag

SEQ ID NO: 148 - DNA, 22 bp, Artificial Sequence
  Primer
tgagctaagatgtgcagtgtca

SEQ ID NO: 149 - DNA, 20 bp, Artificial Sequence
  Primer
aatatgcgtgtgcgtgttgt

SEQ ID NO: 150 - DNA, 20 bp, Artificial Sequence
  Primer
cgttttcgtgggttgatttt

SEQ ID NO: 151 - DNA, 20 bp, Artificial Sequence
  Primer
tctctgaacacacccacacc

SEQ ID NO: 152 - DNA, 20 bp, Artificial Sequence
  Primer
tgttttgatctcagctcccc

SEQ ID NO: 153 - DNA, 19 bp, Artificial Sequence
  Primer
gtagcagaaaccaatgctc

SEQ ID NO: 154 - DNA, 20 bp, Artificial Sequence
  Primer
attcgcgataaatatggact

SEQ ID NO: 155 - DNA, 20 bp, Artificial Sequence
  Primer
tctctgaacacacccacacc

SEQ ID NO: 156 - DNA, 20 bp, Artificial Sequence
  Primer
tgttttgatctcagctcccc

SEQ ID NO: 157 - DNA, 22 bp, Artificial Sequence
  Primer
agccccatgataagagattgta

SEQ ID NO: 158 - DNA, 21 bp, Artificial Sequence
  Primer
catgcaactctgctaaacgaa

SEQ ID NO: 159 - DNA, 22 bp, Artificial Sequence
  Primer
cagctaggatgttgaaggatcg

SEQ ID NO: 160 - DNA, 20 bp, Artificial Sequence
  Primer
gccagctttgactgcactgc

SEQ ID NO: 161 - DNA, 21 bp, Artificial Sequence
  Primer
gcctgaccatactgaacaacc

SEQ ID NO: 162 - DNA, 20 bp, Artificial Sequence
  Primer
gagaagcctaattggggaca

SEQ ID NO: 163 - DNA, 20 bp, Artificial Sequence
  Primer
tggacaaactgggttgtgtg

SEQ ID NO: 164 - DNA, 20 bp, Artificial Sequence
  Primer
tcatatgacgagtggcaacc

SEQ ID NO: 165 - DNA, 24 bp, Artificial Sequence
  Primer
cgggcttatatctttggcaaatgg

SEQ ID NO: 166 - DNA, 20 bp, Artificial Sequence
  Primer
gcctcctccctcctttctcg

SEQ ID NO: 167 - DNA, 20 bp, Artificial Sequence
  Primer
actagagcaccctcgctgag

SEQ ID NO: 168 - DNA, 18 bp, Artificial Sequence
  Primer
ctcagccaccccatcaac

SEQ ID NO: 169 - DNA, 22 bp, Artificial Sequence
  Primer
atcagcaagaaagctctgctcc

SEQ ID NO: 170 - DNA, 23 bp, Artificial Sequence
  Primer
aggaaattcgccctagtagatag

SEQ ID NO: 171 - DNA, 21 bp, Artificial Sequence
  Primer
tgaactcgttcttttgcaccg

SEQ ID NO: 172 - DNA, 22 bp, Artificial Sequence
  Primer
acgaagtccccttcttttcaac

SEQ ID NO: 173 - DNA, 22 bp, Artificial Sequence
  Primer
taaccatctgcaccaccgtacc

SEQ ID NO: 174 - DNA, 23 bp, Artificial Sequence
  Primer
ctctatgtgccgtgatcaaatcc

SEQ ID NO: 175 - DNA, 20 bp, Artificial Sequence
  Primer
acggggagatgattatggtg

SEQ ID NO: 176 - DNA, 19 bp, Artificial Sequence
  Primer
ctcgttgactgcctcgtgt

SEQ ID NO: 177 - DNA, 22 bp, Artificial Sequence
  Primer
agtgatacaaagatgagttggg

SEQ ID NO: 178 - DNA, 22 bp, Artificial Sequence
  Primer
tcctaatgttgggtgggtaaag

SEQ ID NO: 179 - DNA, 20 bp, Artificial Sequence
  Primer
cgctggtaaactccattcct

SEQ ID NO: 180 - DNA, 20 bp, Artificial Sequence
  Primer
cctactcccaacagtcccaa

SEQ ID NO: 181 - DNA, 24 bp, Artificial Sequence
  Primer
aaggaaacatacttagcatgacct

SEQ ID NO: 182 - DNA, 20 bp, Artificial Sequence
  Primer
ctggttagcctctatgggca

SEQ ID NO: 183 - DNA, 22 bp, Artificial Sequence
  Primer
tcctccctcccttcgcccactg

SEQ ID NO: 184 - DNA, 22 bp, Artificial Sequence
  Primer
cgatgttcgccatggctgctcc

SEQ ID NO: 185 - DNA, 23 bp, Artificial Sequence
  Primer
taataggaagagtgcgtcagagc

SEQ ID NO: 186 - DNA, 23 bp, Artificial Sequence
  Primer
tcgaccagtgataaccagtaacc

SEQ ID NO: 187 - DNA, 20 bp, Artificial Sequence
  Primer
tctttggtatgaggaacacc

SEQ ID NO: 188 - DNA, 20 bp, Artificial Sequence
  Primer
agagatccggtttgttgtaa

SEQ ID NO: 189 - DNA, 23 bp, Artificial Sequence
  Primer
aacgtggcatccatgttagtacc

SEQ ID NO: 190 - DNA, 22 bp, Artificial Sequence
  Primer
agctaggagccattgtcgaagg

SEQ ID NO: 191 - DNA, 21 bp, Artificial Sequence
  Primer
gcacactcaattgctcaaatc

SEQ ID NO: 192 - DNA, 20 bp, Artificial Sequence
  Primer
gggctcaaagtagtgctcca

SEQ ID NO: 193 - DNA, 20 bp, Artificial Sequence
  Primer
aacgagcatcacagccttgt

SEQ ID NO: 194 - DNA, 20 bp, Artificial Sequence
  Primer
aggcaaaggagatgcctaca

SEQ ID NO: 195 - DNA, 21 bp, Artificial Sequence
  Primer
tgttcagtgttcagtgccacc

SEQ ID NO: 196 - DNA, 21 bp, Artificial Sequence
  Primer
accttgatcttggtggatgcc

SEQ ID NO: 197 - DNA, 20 bp, Artificial Sequence
  Primer
cgcttattcggattacgaga

SEQ ID NO: 198 - DNA, 21 bp, Artificial Sequence
  Primer
tttccatccacttctacctca

SEQ ID NO: 199 - DNA, 22 bp, Artificial Sequence
  Primer
ctgtgactgacttggtcatagg

SEQ ID NO: 200 - DNA, 20 bp, Artificial Sequence
  Primer
cagtcttgctccgtttgttg

SEQ ID NO: 201 - DNA, 19 bp, Artificial Sequence
  Primer
atcgcagcaatgcctcgtg

SEQ ID NO: 202 - DNA, 19 bp, Artificial Sequence
  Primer
tgcgtttgtgtttggctcg

SEQ ID NO: 203 - DNA, 22 bp, Artificial Sequence
  Primer
cgctgtcagagactgagagaga

SEQ ID NO: 204 - DNA, 20 bp, Artificial Sequence
  Primer
taggtgacgtacgcgtggta

SEQ ID NO: 205 - DNA, 20 bp, Artificial Sequence
  Primer
tcttgcagtttacagacgaa

SEQ ID NO: 206 - DNA, 20 bp, Artificial Sequence
  Primer
acagattcaggccttgttta

SEQ ID NO: 207 - DNA, 20 bp, Artificial Sequence
  Primer
ccctagttttccaaatggcc

SEQ ID NO: 208 - DNA, 20 bp, Artificial Sequence
  Primer
atgtgggaatttctagcccc

SEQ ID NO: 209 - DNA, 20 bp, Artificial Sequence
  Primer
ccctagttttccaaatggcc

SEQ ID NO: 210 - DNA, 20 bp, Artificial Sequence
  Primer
atgtgggaatttctagcccc

SEQ ID NO: 211 - DNA, 23 bp, Artificial Sequence
  Primer
gcgagcgagaggagagatagacg

SEQ ID NO: 212 - DNA, 23 bp, Artificial Sequence
  Primer
cgaattcggcacgagtaataggg

SEQ ID NO: 213 - DNA, 18 bp, Artificial Sequence
  Primer
acactgtagcggccactg

SEQ ID NO: 214 - DNA, 20 bp, Artificial Sequence
  Primer
cctccactgctccacatctt

SEQ ID NO: 215 - DNA, 20 bp, Artificial Sequence
  Primer
acctcatagcttggcaaaaa

SEQ ID NO: 216 - DNA, 20 bp, Artificial Sequence
  Primer
agctcgacctcttcatggtg

SEQ ID NO: 217 - DNA, 20 bp, Artificial Sequence
  Primer
cctatttaatatagcaccag

SEQ ID NO: 218 - DNA, 20 bp, Artificial Sequence
  Primer
ccatttaaacatagaaaaac

SEQ ID NO: 219 - DNA, 20 bp, Artificial Sequence
  Primer
acctgagttccctcctattt

SEQ ID NO: 220 - DNA, 20 bp, Artificial Sequence
  Primer
cttaacctcgtgcatgaaaa

SEQ ID NO: 221 - DNA, 22 bp, Artificial Sequence
  Primer
tgggatgcagagtgcagttggc

SEQ ID NO: 222 - DNA, 22 bp, Artificial Sequence
  Primer
cgcaggcacggtgccttgtaag

SEQ ID NO: 223 - DNA, 20 bp, Artificial Sequence
  Primer
ataaccatcaaaccgcaaga

SEQ ID NO: 224 - DNA, 22 bp, Artificial Sequence
  Primer
ctcggatgtaaagtgagataaa

SEQ ID NO: 225 - DNA, 21 bp, Artificial Sequence
  Primer
cagtaactcaagcataaacgc

SEQ ID NO: 226 - DNA, 18 bp, Artificial Sequence
  Primer
tcgtcgcaagggtaggtg

SEQ ID NO: 227 - DNA, 22 bp, Artificial Sequence
  Primer
aaatgagtttaagtcggctgga

SEQ ID NO: 228 - DNA, 20 bp, Artificial Sequence
  Primer
ggaacggttttgttggttga

SEQ ID NO: 229 - DNA, 20 bp, Artificial Sequence
  Primer
tggtcaaatcatgggctaat

SEQ ID NO: 230 - DNA, 20 bp, Artificial Sequence
  Primer
tattattgtgcctgcgatcc

SEQ ID NO: 231 - DNA, 18 bp, Artificial Sequence
  Primer
ccatagtaagacgacctt

SEQ ID NO: 232 - DNA, 18 bp, Artificial Sequence
  Primer
gatattctgtcagcagtt

SEQ ID NO: 233 - DNA, 22 bp, Artificial Sequence
  Primer
tcagtttaatccattattcaag

SEQ ID NO: 234 - DNA, 18 bp, Artificial Sequence
  Primer
tctacgtacggagggaat

SEQ ID NO: 235 - DNA, 18 bp, Artificial Sequence
  Primer
tattttggagaccgtgtc

SEQ ID NO: 236 - DNA, 18 bp, Artificial Sequence
  Primer
ctgaatgttgcattgtgc

SEQ ID NO: 237 - DNA, 18 bp, Artificial Sequence
  Primer
cgatcttccgatccaccg

SEQ ID NO: 238 - DNA, 18 bp, Artificial Sequence
  Primer
ccggcttcatgggcttag

SEQ ID NO: 239 - DNA, 18 bp, Artificial Sequence
  Primer
gccatgtgaggtgattag

SEQ ID NO: 240 - DNA, 18 bp, Artificial Sequence
  Primer
ctacggttcccagcttct

SEQ ID NO: 241 - DNA, 18 bp, Artificial Sequence
  Primer
cagggatgtcaacgagcc

SEQ ID NO: 242 - DNA, 18 bp, Artificial Sequence
  Primer
cccgtatcaccgacaatg

SEQ ID NO: 243 - DNA, 18 bp, Artificial Sequence
  Primer
gactatgcagtagaggag

SEQ ID NO: 244 - DNA, 18 bp, Artificial Sequence
  Primer
tgtctagtagcaatcaag

SEQ ID NO: 245 - DNA, 18 bp, Artificial Sequence
  Primer
ttttgggacgggaggagt

SEQ ID NO: 246 - DNA, 22 bp, Artificial Sequence
  Primer
gaccgagtgagttgtcgtatct

SEQ ID NO: 247 - DNA, 20 bp, Artificial Sequence
  Primer
aatgccattattatgtagtc

SEQ ID NO: 248 - DNA, 20 bp, Artificial Sequence
  Primer
cctccaattatctgacactc

SEQ ID NO: 249 - DNA, 19 bp, Artificial Sequence
  Primer
tacctctgcttgctccttg

SEQ ID NO: 250 - DNA, 19 bp, Artificial Sequence
  Primer
catgttctactgcaccttc

SEQ ID NO: 251 - DNA, 21 bp, Artificial Sequence
  Primer
attagctgcaactcgttctgc

SEQ ID NO: 252 - DNA, 21 bp, Artificial Sequence
  Primer
tggaagagtatggcctagaaa

SEQ ID NO: 253 - DNA, 22 bp, Artificial Sequence
  Primer
catccattccattccctgttac

SEQ ID NO: 254 - DNA, 22 bp, Artificial Sequence
  Primer
atcttattgttgttgccggtgt

SEQ ID NO: 255 - DNA, 20 bp, Artificial Sequence
  Primer
agagttatgagccgggtgtg

SEQ ID NO: 256 - DNA, 20 bp, Artificial Sequence
  Primer
gatttggcgatcttagcagc

SEQ ID NO: 257 - DNA, 20 bp, Artificial Sequence
  Primer
gatttggcgatcttagcagc

SEQ ID NO: 258 - DNA, 20 bp, Artificial Sequence
  Primer
cacgtgagacaaagacggag

SEQ ID NO: 259 - DNA, 22 bp, Artificial Sequence
  Primer
ccaatcggagccaccggagagc

SEQ ID NO: 260 - DNA, 22 bp, Artificial Sequence
  Primer
cacatcctccagcgacgccgag

SEQ ID NO: 261 - DNA, 18 bp, Artificial Sequence
  Primer
tctcctcttcccccgatc

SEQ ID NO: 262 - DNA, 18 bp, Artificial Sequence
  Primer
atagcgggcgaggcttag

SEQ ID NO: 263 - DNA, 20 bp, Artificial Sequence
  Primer
cttacagagaaacggcatcg

SEQ ID NO: 264 - DNA, 20 bp, Artificial Sequence
  Primer
gctggtttgtttcaggttcg

SEQ ID NO: 265 - DNA, 20 bp, Artificial Sequence
  Primer
gtaggaaaggaagggcagag

SEQ ID NO: 266 - DNA, 22 bp, Artificial Sequence
  Primer
cgatagatagctagatgtggcc

SEQ ID NO: 267 - DNA, 20 bp, Artificial Sequence
  Primer
tcaccgtcgaatcgaatcca

SEQ ID NO: 268 - DNA, 20 bp, Artificial Sequence
  Primer
agtcgaggaaggagaagttc

SEQ ID NO: 269 - DNA, 20 bp, Artificial Sequence
  Primer
ccccgtatacccggattatt

SEQ ID NO: 270 - DNA, 20 bp, Artificial Sequence
  Primer
tggtcgtggacagtgctcta

SEQ ID NO: 271 - DNA, 20 bp, Artificial Sequence
  Primer
catgtgtgatgactgacagg

SEQ ID NO: 272 - DNA, 20 bp, Artificial Sequence
  Primer
ggtgctgtgatgattctttc

SEQ ID NO: 273 - DNA, 20 bp, Artificial Sequence
  Primer
cattgggtttgtgcattcag

SEQ ID NO: 274 - DNA, 20 bp, Artificial Sequence
  Primer
caacgacccatattccaacc

SEQ ID NO: 275 - DNA, 20 bp, Artificial Sequence
  Primer
cgcaggatgtagaggattga

SEQ ID NO: 276 - DNA, 18 bp, Artificial Sequence
  Primer
gtgccgacagcacttggt

SEQ ID NO: 277 - DNA, 20 bp, Artificial Sequence
  Primer
tttatttggcccttggatca

SEQ ID NO: 278 - DNA, 20 bp, Artificial Sequence
  Primer
aaccaaagcatgacgacgtt

SEQ ID NO: 279 - DNA, 20 bp, Artificial Sequence
  Primer
gccagccaagaaaagcgaca

SEQ ID NO: 280 - DNA, 20 bp, Artificial Sequence
  Primer
tcttgagatcccactccatg

SEQ ID NO: 281 - DNA, 20 bp, Artificial Sequence
  Primer
cccttgtgctgtctcctctc

SEQ ID NO: 282 - DNA, 20 bp, Artificial Sequence
  Primer
acgggcttcttctccttctc

SEQ ID NO: 283 - DNA, 20 bp, Artificial Sequence
  Primer
ggagcttagaatctcaccta

SEQ ID NO: 284 - DNA, 20 bp, Artificial Sequence
  Primer
cgcattttcctatacataca

SEQ ID NO: 285 - DNA, 21 bp, Artificial Sequence
  Primer
cagttccgagcaagagtactc

SEQ ID NO: 286 - DNA, 19 bp, Artificial Sequence
  Primer
ggatcggacgtggcatatg

SEQ ID NO: 287 - DNA, 20 bp, Artificial Sequence
  Primer
gtgagtgatcttcatcagtg

SEQ ID NO: 288 - DNA, 20 bp, Artificial Sequence
  Primer
cgatggttatctgtaaacag

SEQ ID NO: 289 - DNA, 21 bp, Artificial Sequence
  Primer
gtagtgagcctaacaataatc

SEQ ID NO: 290 - DNA, 20 bp, Artificial Sequence
  Primer
tcaactcagcatctctgtcc

SEQ ID NO: 291 - DNA, 18 bp, Artificial Sequence
  Primer
atgccgccagtgaatagc

SEQ ID NO: 292 - DNA, 22 bp, Artificial Sequence
  Primer
ctgagaatccaattatctgggg

SEQ ID NO: 293 - DNA, 20 bp, Artificial Sequence
  Primer
gtatccgctccgttttcatc

SEQ ID NO: 294 - DNA, 20 bp, Artificial Sequence
  Primer
gaggggggggtgtagaatag

SEQ ID NO: 295 - DNA, 20 bp, Artificial Sequence
  Primer
ctctcaaagaactaggactc

SEQ ID NO: 296 - DNA, 20 bp, Artificial Sequence
  Primer
gagaaggtatgataaccaat

SEQ ID NO: 297 - DNA, 20 bp, Artificial Sequence
  Primer
ctgacaggacattaaaaaac

SEQ ID NO: 298 - DNA, 20 bp, Artificial Sequence
  Primer
cctcatccttaatctcttta

SEQ ID NO: 299 - DNA, 20 bp, Artificial Sequence
  Primer
ctggatgaaaggatacaaca

SEQ ID NO: 300 - DNA, 20 bp, Artificial Sequence
  Primer
cacattatctgtcaaggtcc

SEQ ID NO: 301 - DNA, 21 bp, Artificial Sequence
  Primer
tcaaaccggcacatataagac

SEQ ID NO: 302 - DNA, 21 bp, Artificial Sequence
  Primer
gatagggagctgaaggagatg

SEQ ID NO: 303 - DNA, 20 bp, Artificial Sequence
  Primer
atttcccacacatctcgctg

SEQ ID NO: 304 - DNA, 18 bp, Artificial Sequence
  Primer
gtgtcgccggtcaagaac

SEQ ID NO: 305 - DNA, 18 bp, Artificial Sequence
  Primer
ctggccattagtccttgg

SEQ ID NO: 306 - DNA, 18 bp, Artificial Sequence
  Primer
gcttgcggctctgcttac

SEQ ID NO: 307 - DNA, 20 bp, Artificial Sequence
  Primer
catcgcatcgtatcgtatcg

SEQ ID NO: 308 - DNA, 20 bp, Artificial Sequence
  Primer
gcttcaaacacgccttcttc

SEQ ID NO: 309 - DNA, 19 bp, Artificial Sequence
  Primer
ccggtcagttcaagctctg

SEQ ID NO: 310 - DNA, 18 bp, Artificial Sequence
  Primer
acgtacggacgtgacgac

SEQ ID NO: 311 - DNA, 20 bp, Artificial Sequence
  Primer
gtgtactgccatgaaaggcc

SEQ ID NO: 312 - DNA, 20 bp, Artificial Sequence
  Primer
gaagtgcctttgcaggagag

SEQ ID NO: 313 - DNA, 20 bp, Artificial Sequence
  Primer
cagctagtgagctcctagtg

SEQ ID NO: 314 - DNA, 20 bp, Artificial Sequence
  Primer
gctaacccaccaacttattc

SEQ ID NO: 315 - DNA, 20 bp, Artificial Sequence
  Primer
aatctccactgcagcgattc

SEQ ID NO: 316 - DNA, 20 bp, Artificial Sequence
  Primer
cgaatggtcaaacgtaggtg

SEQ ID NO: 317 - DNA, 22 bp, Artificial Sequence
  Primer
cagattggagatgaagtcctcc

SEQ ID NO: 318 - DNA, 20 bp, Artificial Sequence
  Primer
ccagcaagcatgtcaatgta

SEQ ID NO: 319 - DNA, 20 bp, Artificial Sequence
  Primer
tgcccaaaatatatgaaacc

SEQ ID NO: 320 - DNA, 20 bp, Artificial Sequence
  Primer
ttttcttgttgaatgggaac

SEQ ID NO: 321 - DNA, 20 bp, Artificial Sequence
  Primer
gctaccttagctaggtgatc

SEQ ID NO: 322 - DNA, 20 bp, Artificial Sequence
  Primer
atgtaaaatttgcatgtttg

SEQ ID NO: 323 - DNA, 22 bp, Artificial Sequence
  Primer
tgccctggcgcaaatttgatcc

SEQ ID NO: 324 - DNA, 28 bp, Artificial Sequence
  Primer
gctagaggagatcagatggtagtgcatg

SEQ ID NO: 325 - DNA, 20 bp, Artificial Sequence
  Primer
accgtagcgttagcatggac

SEQ ID NO: 326 - DNA, 20 bp, Artificial Sequence
  Primer
actacgagaatgcggtgctt

SEQ ID NO: 327 - DNA, 20 bp, Artificial Sequence
  Primer
cttggctctcgtgaaagacc

SEQ ID NO: 328 - DNA, 20 bp, Artificial Sequence
  Primer
ccatgcatggggatataagg

SEQ ID NO: 329 - DNA, 20 bp, Artificial Sequence
  Primer
ctgaggtgggagttgtaccc

SEQ ID NO: 330 - DNA, 20 bp, Artificial Sequence
  Primer
tcttcgatacccatgccaat

SEQ ID NO: 331 - DNA, 20 bp, Artificial Sequence
  Primer
acatgatgcgtagcgagttg

SEQ ID NO: 332 - DNA, 20 bp, Artificial Sequence
  Primer
ctctcccttcccaattcctc

SEQ ID NO: 333 - DNA, 20 bp, Artificial Sequence
  Primer
cccaccaccaactttagccc

SEQ ID NO: 334 - DNA, 22 bp, Artificial Sequence
  Primer
tgacatggaaattgacattctt

SEQ ID NO: 335 - DNA, 20 bp, Artificial Sequence
  Primer
cttggctctcgtgaaagacc

SEQ ID NO: 336 - DNA, 20 bp, Artificial Sequence
  Primer
ccatgcatggggatataagg

SEQ ID NO: 337 - DNA, 25 bp, Artificial Sequence
  Primer
tccaccactctgacgtctactaacc

SEQ ID NO: 338 - DNA, 22 bp, Artificial Sequence
  Primer
ctgcgggaagtgtaggagaagc

SEQ ID NO: 339 - DNA, 20 bp, Artificial Sequence
  Primer
ttttcatcctagatggttgc

SEQ ID NO: 340 - DNA, 20 bp, Artificial Sequence
  Primer
tacgatccaagaagctgtct

SEQ ID NO: 341 - DNA, 20 bp, Artificial Sequence
  Primer
taatagatcgggactagact

SEQ ID NO: 342 - DNA, 20 bp, Artificial Sequence
  Primer
caatactttaaaacttggac

SEQ ID NO: 343 - DNA, 20 bp, Artificial Sequence
  Primer
gagtaatggcagtttgattg

SEQ ID NO: 344 - DNA, 20 bp, Artificial Sequence
  Primer
gcaggttacgctagttaaaa

SEQ ID NO: 345 - DNA, 31 bp, Artificial Sequence
  Primer
cccaagcttacactccagccattaagcaccg

SEQ ID NO: 346 - DNA, 30 bp, Artificial Sequence
  Primer
gcgtcgacctcctccgactccgactcctcc

SEQ ID NO: 347 - DNA, 29 bp, Artificial Sequence
  Primer
gcgtcgacatgcctccggcgagggtgctc

SEQ ID NO: 348 - DNA, 34 bp, Artificial Sequence
  Primer
cggggtacctcagcttgtactactaaatgacagc

SEQ ID NO: 349 - DNA, 33 bp, Artificial Sequence
  Primer
gcgtcgacgcttgtactactaaatgacagctgc

SEQ ID NO: 350 - DNA, 26 bp, Artificial Sequence
  Primer
gctctagaatgcctccggcgagggtg

SEQ ID NO: 351 - DNA, 27 bp, Artificial Sequence
  Primer
gaattcatgcctccggcgagggtgctc

SEQ ID NO: 352 - DNA, 34 bp, Artificial Sequence
  Primer
gtcgactcagcttgtactactaaatgacagctgc

SEQ ID NO: 353 - DNA, 26 bp, Artificial Sequence
  Primer
agatctaaactgttaccaagagctcc

SEQ ID NO: 354 - DNA, 28 bp, Artificial Sequence
  Primer
ctcgaggttccactgtccaccttgcatc

SEQ ID NO: 355 - DNA, 26 bp, Artificial Sequence
  Primer
tctagaaaactgttaccaagagctcc

SEQ ID NO: 356 - DNA, 28 bp, Artificial Sequence
  Primer
gtcgacgttccactgtccaccttgcatc

SEQ ID NO: 357 - DNA, 31 bp, Artificial Sequence
  Primer
gcgtcgacctacttccttaattgaagcgact

SEQ ID NO: 358 - DNA, 29 bp, Artificial Sequence
  Primer
gcgaattcatgtacaacggatggcgactt

SEQ ID NO: 359 - DNA, 31 bp, Artificial Sequence
  Primer
gcgtcgacctatggatcctcaaccaatagca

SEQ ID NO: 360 - DNA, 28 bp, Artificial Sequence
  Primer
gcgaattcatgctgaatggaatagaaga

SEQ ID NO: 361 - DNA, 29 bp, Artificial Sequence
  Primer
gcgaattcatgagcatggtgaaggagatc

SEQ ID NO: 362 - DNA, 30 bp, Artificial Sequence
  Primer
gcgtcgacctaggcctcaaaattttctggt

SEQ ID NO: 363 - DNA, 28 bp, Artificial Sequence
  Primer
gcgaattcatggacgactacgcgcggga

SEQ ID NO: 364 - DNA, 30 bp, Artificial Sequence
  Primer
gcgtcgacttactcagcaccgtcgcctgga

SEQ ID NO: 365 - DNA, 29 bp, Artificial Sequence
  Primer
gcgtcgacaatggacgactacgcgcggga

SEQ ID NO: 366 - DNA, 29 bp, Artificial Sequence
  Primer
gactagtttactcagcaccgtcgcctgga

SEQ ID NO: 367 - DNA, 31 bp, Artificial Sequence
  Primer
gcgtcgacaatgagcaccgcctccggcgacg

SEQ ID NO: 368 - DNA, 28 bp, Artificial Sequence
  Primer
gactagttcaggcctcttccacttgctc

SEQ ID NO: 369 - DNA, 31 bp, Artificial Sequence
  Primer
gcgaattcaatgagcaccgcctccggcgacg

SEQ ID NO: 370 - DNA, 29 bp, Artificial Sequence
  Primer
gcgtcgactcaggcctcttccacttgctc

SEQ ID NO: 371 - DNA, 20 bp, Artificial Sequence
  Primer
ccactatgttccctggcatt

SEQ ID NO: 372 - DNA, 20 bp, Artificial Sequence
  Primer
gtactcagccttggcaatcc

SEQ ID NO: 373 - DNA, 20 bp, Artificial Sequence
  Primer
cccctagcatcgacaccaag

SEQ ID NO: 374 - DNA, 19 bp, Artificial Sequence
  Primer
cgggttccagcactcctct

SEQ ID NO: 375 - DNA, 30 bp, Artificial Sequence
  Primer
ggggtaccacactccagccattaagcaccg

SEQ ID NO: 376 - DNA, 30 bp, Artificial Sequence; identical to SEQ ID NO: 346
  Primer

SEQ ID NO: 377 - DNA, 32 bp, Artificial Sequence
  Primer
ggggtaccgcaatatctataacacgacattag

SEQ ID NO: 378 - DNA, 29 bp, Artificial Sequence
  Primer
ggggtacccaaacccgtcaagaggaacct

SEQ ID NO: 379 - DNA, 20 bp, Artificial Sequence
  Primer
tctcatctcacgcgtcccaa

SEQ ID NO: 380 - DNA, 29 bp, Artificial Sequence
  Primer
cagatatcatcaccgtttcatattatacg

SEQ ID NO: 381 - DNA, 28 bp, Artificial Sequence
  Primer
cgggatccctcctcctccgactccgact

SEQ ID NO: 382 - DNA, 29 bp, Artificial Sequence
  Primer
gctctagaatggagtgggatctcaagatg

SEQ ID NO: 383 - DNA, 28 bp, Artificial Sequence
  Primer
ggaattcctactgccatgagaacggcag

SEQ ID NO: 384 - DNA, 19 bp, Artificial Sequence
  Primer
gccattaagcaccgaagac

SEQ ID NO: 385 - DNA, 20 bp, Artificial Sequence
  Primer
gctactggttagccgaaaag

SEQ ID NO: 386 - DNA, 20 bp, Artificial Sequence
  Primer
cttttcggctaaccagtagc

SEQ ID NO: 387 - DNA, 20 bp, Artificial Sequence
  Primer
gtgaaaatgcctactcgctc

SEQ ID NO: 388 - DNA, 22 bp, Artificial Sequence
  Primer
gtaggagcgagtaggcattttc

SEQ ID NO: 389 - DNA, 18 bp, Artificial Sequence
  Primer
taccgccagaggttaggg

SEQ ID NO: 390 - DNA, 20 bp, Artificial Sequence
  Primer
taacctctggcggtacgatg

SEQ ID NO: 391 - DNA, 23 bp, Artificial Sequence
  Primer
taatgtcgtgttatagatattgc

SEQ ID NO: 392 - DNA, 24 bp, Artificial Sequence
  Primer
gcaatatctataacacgacattag

SEQ ID NO: 393 - DNA, 21 bp, Artificial Sequence
  Primer
gctcacttacgttttattccc

SEQ ID NO: 394 - DNA, 20 bp, Artificial Sequence
  Primer
cggagggaataaaacgtaag

SEQ ID NO: 395 - DNA, 20 bp, Artificial Sequence
  Primer
cgattaggttcctcttgacg

SEQ ID NO: 396 - DNA, 19 bp, Artificial Sequence
  Primer
aaacccgtcaagaggaacc

SEQ ID NO: 397 - DNA, 18 bp, Artificial Sequence
  Primer
ggagggatgggggattgg

SEQ ID NO: 398 - DNA, 18 bp, Artificial Sequence
  Primer
ggagggatgggggattgg

SEQ ID NO: 399 - DNA, 22 bp, Artificial Sequence
  Primer
acactccagccattaagcaccg

SEQ ID NO: 400 - DNA, 48 bp, Artificial Sequence
  Primer
tagtgtacgtacctcttagtgtacgtacctcttagtgtacgtacctct

SEQ ID NO: 401 - DNA, 48 bp, Artificial Sequence
  Primer
agaggtacgtacactaagaggtacgtacactaagaggtacgtacacta

SEQ ID NO: 402 - DNA, 48 bp, Artificial Sequence
  Primer
tagtgtgcgtgcctcttagtgtgcgtgcctcttagtgtgcgtgcctct

SEQ ID NO: 403 - DNA, 48 bp, Artificial Sequence
  Primer
agaggcacgcacactaagaggcacgcacactaagaggcacgcacacta

SEQ ID NO: 404 - DNA, 48 bp, Artificial Sequence; identical to SEQ ID NO: 400
  Primer

SEQ ID NO: 405 - DNA, 48 bp, Artificial Sequence; identical to SEQ ID NO: 402
  Primer

SEQ ID NO: 406 - DNA, 63 bp, Artificial Sequence
  Primer
ccattgacacaccataccacatctcatctcacgcgtcccaaagaaagtgatagtgtacgtacc

SEQ ID NO: 407 - DNA, 63 bp, Artificial Sequence; identical to SEQ ID NO: 406
  Primer

SEQ ID NO: 408 - DNA, 63 bp, Artificial Sequence
  Primer
ggtacgtacactatcactttctttgggacgcgtgagatgagatgtggtatggtgtgtcaatgg

SEQ ID NO: 409 - DNA, 30 bp, Artificial Sequence
  Primer
cgcggatccatggagtgggatctcaagatg

SEQ ID NO: 410 - DNA, 29 bp, Artificial Sequence
  Primer
cggaattccatctgccatgagaacggcag

SEQ ID NO: 411 - DNA, 2631 bp, Sorghum bicolor; identical to SEQ ID NO: 51

SEQ ID NO: 412 - DNA, 2631 bp, Sorghum bicolor; identical to SEQ ID NO: 51

SEQ ID NO: 413 - protein, 876 aa, Sorghum bicolor; identical to SEQ ID NO: 53

SEQ ID NO: 414 - DNA, 717 bp, Brassica napus
atgtctgctccttcatgcagtgtcggaggagaagtaggtggtgaaacatgttcggctctagctaagtcgtccctgccaccgccgcctcgcccgaagtctccgccagaatatccagatttgtacgggaaacgcagagaggcggcgagagtccagatgctagagagagagattggttttctcgagggggaaattaaattcatccaaggcgtacaaccggcttccagatgctgcaaagaggtctctgattttgtcgttgcaaattctgacccattgatccctgcacaacaaaagagtcaaagacacggccagttctggaagtggctctgttgcggtattccatgtttgagcctagcgagtttcttctgttgctgccgatccaactgttcgtgccatctgaggaagcccaagtgctgtaactgcacaagttgcagctgcactggttccaaatgctgtgaaggatcatgttgctcaaatagctgttgttgcccgaaactgagctgcccgagctgttcatgcttccgaggttgctgttgttcttgtccggacttatcttgctgcctacccacctgtctgaataagaagaagaagagctcctgttgcagctgcaactgcaagatcagatggtcatcttgtttcagatgccccaaggtacaactttgttgttgttttcgcaattgtaaaaatctatgttctaatccttgttgtttagctttctaa

SEQ ID NO: 415 - protein, 238 aa, Brassica napus
MSAPSCSVGGEVGGETCSALAKSSLPPPPRPKSPPEYPDLYGKRREAARVQMLEREIGFLEGEIKFIQGVQPASRCCKEVSDFVVANSDPLIPAQQKSQRHGQFWKWLCCGIPCLSLASFFCCCRSNCSCHLRKPKCCNCTSCSCTGSKCCEGSCCSNSCCCPKLSCPSCSCFRGCCCSCPDLSCCLPTCLNKKKKSSCCSCNCKIRWSSCFRCPKVQLCCCFRNCKNLCSNPCCLAF

SEQ ID NO: 416 - DNA, 705 bp, Brassica nigra
atgtctgctccttcatgtagtgtcggaggagaagtaggtggtgaaacatgttcggctcttgctgagtcgtcttccctaccgccgcctcgtccgaagtctccgccggaatatccagatttgtacgggaaacgcagagaggcggcgagagtccagatgctagagagagagattggttttctcgagggggaaattaaattcatccaaggggtacaaccggcttctagatgctgcaaagaggtctctgattttgtcgttgcaaatcctgacccattgatccctgcacaacaaaagagtcaaagacacggccggttttggaagtggctctgttgcggtattccgtgtttgagcctagcgagtttctgctgttgctgccgatccgagtgttcctgccgtccgaggaagcccaagtgctgcattggttccaaatgttgtggcggatcatgcagctcaaatagctgctgttgcccgagctgttcatgcttccgaggttgtggctgttcttgtccggacttatcttgctgcatacccacctgtttcggcagttgcactcgaccttcgtgtctgaataagaagaagagctcctgttgcagctgcaactgcaagatcagattgtcatcttgttttagatgtcccaagttacgactttgttgttgttttagcaattgtaaaaatctatgctctaatccttgttgtttagctttctaa

SEQ ID NO: 417 - protein, 234 aa, Brassica napus
MSAPSCSVGGEVGGETCSALAESSSLPPPRPKSPPEYPDLYGKRREAARVQMLEREIGFLEGEIKFIQGVQPASRCCKEVSDFVVANPDPLIPAQQKSQRHGRFWKWLCCGIPCLSLASFCCCCRSECSCRPRKPKCCIGSKCCGGSCSSNSCCCPSCSCFRGCGCSCPDLSCCIPTCFGSCTRPSCLNKKKSSCCSCNCKIRLSSCFRCPKLRLCCCFSNCKNLCSNPCCLAF

SEQ ID NO: 418 - DNA, 2718 bp, Arabidopsis thaliana; identical to SEQ ID NO: 36

SEQ ID NO: 419 - DNA, 3768 bp, Arabidopsis thaliana; identical to SEQ ID NO: 37

SEQ ID NO: 420 - protein, 616 aa, Arabidopsis thaliana; identical to SEQ ID NO: 38

SEQ ID NO: 421 - DNA, 9354 bp, Arabidopsis thaliana
atgaggagcagcaaatcaaaagaggtgcctttaccaaatccaaggaactctcaaagcaaggatactgttcaagcagatataaccacatcgtgggatgcactttctcaaaccaaggctgctctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaagaaaagactgagagcggtaactggatgataggcagtcgagaagaacggaatatacggagctgtgattttgagagctcccaatcatctgtcatcaatgatacagttgttaggtttttaaatgatcgaccagcaattgatgcattgcaaaattctgaatgtttgattaggatgggagcttctatgagaactgaggaagaaatgcctaacagaacaaaaggaagtgagaataatttgaagctttctgtgaataacatggcccatgatactgatccaaaagcgttacgactaactgactcttctccatcctctactagtacttctaattcccaaagattagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtga

SEQ ID NO: 422 - DNA, 13473 bp, Arabidopsis thaliana
acagccgctgccgctggcgccgctcctcctccgtgtcagttgttgggctgtaatggcgactgggccgcccctgacgaagtgactcccgggccggggagcggggccagacctgcgccagagagaactgcagggagccgcagctcggggggtggcttgccctgagggaggggaggcagcctttccgccttgtcttccttcccagcggaccggcggatccccggagccggtgcgaggagggcacccggtgcgtccccggagcggggaggccaggccgggcagccctggggccggtcggggcggcgtcactgcaccctccgccaggctccgcgggatgcaccgtggtagccgagggcggaggcgacactctcaggtaaattggcaggatgaggagcagcaaatcaaaagaggtgcctttaccaaatccaaggaactctcaaagcaaggatactgttcaagcagatataaccacatcgtgggatgcactttctcaaaccaaggctgctctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaagaaaagactgagagcggtaactggatgataggcagtcgagaagaacggaatatacggagctgtgattttgagagctcccaatcatctgtcatcaatgatacagttgttaggtttttaaatgatcgaccagcaattgatgcattgcaaaattctgaatgtttgattaggatgggagcttctatgagaactgaggaagaaatgcctaacagaacaaaaggaagtgagaataatttgaagctttctgtgaataacatggcccatgatactgatccaaaagcgttacgactaactgactcttctccatcctctactagtacttctaattcccaaagattagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaatttcaaaaaaaaaaaaaaaaaa

SEQ ID NO: 423 - protein, 3117 aa, Arabidopsis thaliana
MRSSKSKEVPLPNPRNSQSKDTVQADITTSWDALSQTKAALRHIENKLEVAPTSTAVCDSVMDTKKSSTSATRKISRKDGRYLDDSWVNAPISKSTKSRKEKSRSPLRATTLESNVKKNNRVEFREPLVSYREIHGAPSNFSSSHLESKHVYCVDVNEEKTESGNWMIGSREERNIRSCDFESSQSSVINDTVVRFLNDRPAIDALQNSECLIRMGASMRTEEEMPNRTKGSENNLKLSVNNMAHDTDPKALRLTDSSPSSTSTSNSQRLDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 424 - DNA, 9291 bp, Arabidopsis thaliana
atgaggagcagcaagtcaaaagaggtgcctttaccaaatcccaggaactctcagagcaaggagactattcaagtagatgtaaccacatcatgggatgcactttctcagaccaaggctgctctgagacacattgagaacaaattagaagtaactcctacaagcacagctgtaatcgattctgtgatggatactaagaagtctgcaagtgctacccgaaaaataagtaggaaagatgggagatgtctagatgattcttgggccagtgctccaacttccaaattttccaaaccacggaaagagaaatcccgtagtcctctcagggctaccaccctggaaagtaatgttaagaaaaacaatcgtgtggagttccgtgaacctttggtttcttatagggaaacccacggtacacctttcagcttaagtcccagtcatctggagtcaaagcatgtctattgtattcacgaggagaagcccgagagtgggaagcagatggtagttagtcgggaagaccggaatatccagtgctgtgattttgagagtgctcagccctcggtcatcagtgatacagttgttagatttttaaatgatggaccagcaattgatgcattgcacagttctgaatgtttaatgaaaatgggagtacatgtaagaactgaggatgaaatgcctaacagaacaaaaggaagtgagaacaattcaaagccttctcttaacaacatggaacatgatgttgatccgaaagtgatgctgctgtctgactcttctccatcctctagtgcctgtaattcccaaagatcagatatttcaaagcggcagcaacatgatattaaactggaaaaacttaaagagcggattaggaaacagtgggaacactcagaagaaataaacggccaggcccagactctaggtcatattgaccatccagtaatggttgttaatgttgacaactcggtgacaacgaaagtcaggaaagtggcaacagcaccacctgctccagcatacaaaggtttcaacccgtcagagaccaagattcgcactcctgatggaaaagtgtggcaggaggcggagtttcaaagcatgagtagagagctgtaccgagacttagcacttcagttcacagatgatacctctgtaaaagagaagcctgttgaaaaaagtaaagagaagaaagtggttaaaccagtacgaaaaatccaaaaagtgacacagttatcaaatccagaatgcaaaacaggtagcagtcgtttgataagtacatcttcttggcgagatggacaaaaattagtaaagaagattctgggacctgcacccaagatggagcaaaaagagcgaagacccacatcgaatgacagaagtggaagagaaagagtggctaaatttgggggccatattggaagagcagaatcggaccccaaattggatgtttcacataaacagcttccacgaagctcagcacgttcaagaagtagtagagcttggtctgaaactaatatagtgaaatcagctctgtcccttccagacaataagcaggaggaaagcgctgccttaaacaaggattttttgccagttgaaattcgtgggattcttgatgacttacagctagattcttcagctcaagctgtgaggcaagaggctggagagggacagaatcagaagtcatcggcccctgaacaagtacctcggagtcacagccccgtgaaaagaaagccagacaaaataacagcgaacgaggatccgcctgtgatttccaagaagcgccactatgacacagatgaggtacgacagtacattgttagacagcaggaggagaggaggaggaggcaacacgaagagaagaaggctcagaaggaggctacggagcagaagaacaaacgattacaggagctctaccggagacagagggaagccttctctaaagcaaaaactgtgcctccttctgacccattggtctctagacggcttcaggaaacttactccaaattgctactagaaaagactttgcttgaagaaccagcccgtcagcatgttacacaggacatacaggccagacctgggtatcagccatctggagaatctgataaagaaaacaaaatacaggagcgtcccccaagtgcgtcttccagtagtgacctgtccctgtcagagcctccacaacctcttgcaagaagagacttgatggagcctacatggatgcagcctgacagactgagccctcgagttcacagttctcaagcccagcccctcgctggaacgactgagaatttactctcccatctcctgcatcttgagcatgtaggaattttgcacaaggactatgaatctgttttaccagccaagaagagtcataatacggcttcaggaccgttaactttcacacctcaaccatatctgacctcacaagctcctcatccagatgccttgttgaaacctagtaccagccaatataagactaaactggatcgtattgaagccctgaaagcaacagcggcctctctgtccagtaggattgagagtgaggctaagaaactagctggggccagcattaactatgggtcagtgtggaacaccgagtgtgatgtgaagctagcacctcaagagaatggaccttggactaaagctatcagtccacctgtgaaagaggacattgaagatgctttctctgcccggattcagaagatgctgggaacctgtgtgtctcatgcagcttttgacgatgagcttcctggtgtaggcagccttagtgaatataaaaaacttcctgagatgatcagaccccagagtgccatatcaagcttacgaatgaaatcccctagtcctaagccaggagggctgctggcacagttgtgcaggaggcagacagattcttccagctctgacatacaagcctgttctcaagaaagagccaaaaggtctctttgttccagcatagactcagtcagtgaagggcctcttcttagtgaagggagtctctctgaggaagaagaacgccgggatgcacggccccttttgaaggtagcggaaattttaaaggaaaaagaattctgtgctggggagagaaactcttatgaacccatcaaagagtttcagaaagaagctgagaaattcttgccactttttgggcacataggtggtacacaaagcaaaggaccatgggaagaactggcaaagggaagtccacacagcgtcattaatatttttactaagtcatatcagttatatggaaaagggtttgaagacaggggaacattggtatcacggcctttgaatgccaccgcaaccccactcagcagcgtttcctatgaagatgattttgtctcctctccaggaagtgggacactgacagaaaggaagtcaactcttgaatcccaagttgatggtagcagcttgggcgttcaggaggagcatctgagcagacagtttgcctgtgaccttgcctctgtggatgctacctcccagcactcctcgggagctcgctctgctgggtccactcgctcctcctcagcttctaaagggaagaaggggaagaaagacaagatggactggttggattccctcactggaagtgctcagaacccactcattgatgaggaaaaagtacagtcagactcagaacgcggctcccatccaagcaggaagcttgggactggcagcaaacttgctgttggagactctgagcagactctggatgctgagagcacactggaagacctgtctgggcactctgtgagtggctcttcagacaagggaagatctcagaagactccaacttctcccctatctccaagttcacagaaattgttacagtttgaccttcctgggacttccttagaaagatctaagtcctcagtcatagtacctccaactacaactggatttaagcccactgcagcttttactgacgtgaataaaacagagatggcttcagcaccaggtcctcagcgtttctctcctgctggccttcagcatcgcatggctgcagaactcagttacctgagtgctctcgaggagtcagtgcgccagctgtccgacgtggagagagttaggggcattgccctcgctcagcaggagagtgtatctctggctcagatcataaaggcacagcagcaacgtcatgaaagagatttggccttattgaagctaaaagctgaacaggaggctttggagtgtcagagacagttagaagaaacccggaacaaaacagctcaggtccatgcagaatctttacagcaggtggttaaatcacaaagagaagtgactgaagtcctccaggaagcaacttgtaaaatagcagctcagcaatcagagaccgcgcgcctcaccacagatgcagcgcggcagatctgtgagatggcagaactaactcgaacacacctcgcagatgccatcacaacttctggagttcccctagcaacactgtacgaccaccagcggcagcattttccagacttcatgagaaaactgaggaccaaagctgaaacagataggataagtcattctgcttcacactcccagagtaaagaaggcgctgtggactccaagcggcagaagttctccccttcccgtgacagttactctgagtcttcaagatacaagagtcatgattaccggagtagtggtagcagccgacaggacagcccttccgttccacccagtaaggagaatgagaagccattccatggtgagaagatggagagctcagttgatgaacagttgcagacagccgcagatgattccttacgaagtgacagtattccgtctctgcctgatgagaaagactcaacttctattgcaacagaatactccctgaaatttgatgaatctatgacagaagatgaaatagaagaaaagtcatttcgctctctactaccttctgagagtcatcgtagatttaacatggaaaagaaaagaggccatcatgacgactcggatgaggatgcttccccagacaagactgctctgtcttctaccaaggagctgagcatgccattctcaggaggacaggatagcttttctaagttcaccatggagatggtgcggcagtacatgaaggaagaggaagtgcgcgcagctcaccagtcctcacttctgcgtcttcgagaaaaggccttaaaggagaagacaaaggccgaactagcctggctagagcatcagaaaaagcatctacgagacaaaggagaggatgataagatgcccccactccggaagaaacagcgtggtttgcttttaagacttcagcaagaaaaggcagaaatcaaacgtcttcaagaagccaataaggcagcccggaaagagaggcagctgatccttaagcagcaggaggagatcgagaggatccgccagaccaccataaaactgcaggagaagctcaagtctgcaggggagaagaaattgggctctcttgctgatgatgatgaagcagaggacaacaaggcagctagtcctgggccacccggcttggagacccgcagtccttccccgatatcgatttccagcagtgagaccagcagcatcatgcagaagctcaagagcatgagaagccgcatggacgagaagttcctgacgaagcgagaacagaagctcatgcagcgccgccagcacgcagaggagctcctggagtggaagcggcgtctggatgcagaagaagcggaaatccaacaaatggaaaaacaagctttggctgcctgggacaaagaactagtaaaacccagaactcctaagaaagaacaggagagccagagaacagagcagaaaggaatagcaagtgaagagggatcaccaatgccttcttactctccgaggaacagtgaaagttgtattccagaagacctcggcagtccttctgacttatgtgttccttctgaggctagggtacaggcacagcctgggagtccagagcacagcacacttactgaggagatggttttttcacaggagctggaatctacctctcctagcaaacattcacctcccaaaagttgcttatctatgtcaaagcaagaatctagcaaagcaagtcacaggactgaaggacactgtcatctgcctgtcaagtctcaccaaccctgttacagttggtcagatgagtcactgtctatgacacagtcagaaaccacatctgaccagagtgacattgaagggaggatcagagctctgaaggatgagctgcggaagaggaagtcagtcgtggagcagctgaagagggagcagaggaagagacagaaggagagactgaaggcccaggaggccagtctgctcagacagctggagacttatgatgaattcattaagaaaactgaaggtgaactcagccaagatctagacatatccccaacatccaaatttcaaatgaaaactctctcctccgtatccgaaaaacccaaaatcaagccacacccactacacagatctgaaacagcaaaaacttggaaatctgtaacagagtcagagcgttccagagggtccttggcatccattgctgaacatgttgattcttcattatcatgttctgagagagccatatcagaaaggtcactatctgcatatgcaaagagaggggttgagttggacagccggatagaacatttgcaagcctcatctccagatctgtcatctagaaaagcacagacagagtctagagattctcttgaaagcgcaccctcgttatctcctgtgaaggaattaaatgcacctgatcggatttatgatgtgtcagaggctaaggctgaagatactagtcagaaatcagaaatacaagaaatagagtccatgaaactggagagcagtgaggttgaagatgcctgctgtaagcagtcaggcggatctgaagtcctactgaaactagacctggcctctgaaaccctgtcaagtaaagaacttccctcagactctgcaaatgtgcagcaagacttagataaaccagccacagaaacgtctcatgaaaaagaggaagcactgaaagaggatcagtccaatcacagtacagatgaccgcagtccagacatccagtcagcaggaggcatccctgagcaaggatgcagagagagtggggactccacatgctcaggacagctttctgttcctaaagagtcgtcctactctgaagattttgaagtgtcttctttcaggaaagggatttctgctgacgagattagtaaagatgactctgaggggtcctcaccatcgtcgctcaggaaggactctcagtctcacagagataggtcacagctcacaaggagctccagaagcagagccaccgggtctggaagcgatgaggagatcagcgagtgtctcggtgagaaaagcctctctgttcatagtggcgtccactcggaaaggctgctggagctcaggtcacccacagagctaatgaagagtaaggagcgcagcgacgtggggcacgagcagggggggactgagccccttcccctggctgccacagaggagctactagatttccacattggggatagggtgttgatcggcagtgttcagccaggtactcttcggttcaaaggtgagactgactttgctaaagggttctgggctggagtggagctggacaagcctgaaggaaacaacaatgggacctatgatgggattgtgtattttgtgtgcaaagacaagcatggtatttttgctcctcctcaaaaaatatctcaccttctagaaaactttgatgatacagacataaatgaagatgaagagtcttactcagatgaacagtaccaaccctataatcaagagcagaaagatataaaatgtctaaaagacagagaaaacaatatagctgaatatttttgtgagaagtcacttcctagtatgcataatacagatgcctcagtggataaagatagaagccttaacatagaaacagatacttctgaggtcctagaggtccatggtcaccaacagccttcagtagatcctctgatttcttataaggagaacaaagtccttgtttctgatgccacagagagtgttcctgctgctgcgggtgctgctacttcagacaacacgttttctggagaatcaaagcaacagcagcttgcagagaaggaagagaacttttattctcaagttttggaaaagccctctacccctcttctggatcttttaacaagagaaaaaaaccaattagaagctcagctgaagtcatcaataagtgaagaaaaaaagtcaaagcagcaactagagacagtcagcttactaacagacagtttactacaagtctttgtgaaagacacagttagtcaactacaacaagtcaaaaaggctagaaatgagaaaatccagcttagcaatcaggagtttcttgaccaaaagaaagtaccaccccaagacctaccccaaaatactgaagaacaatcacccagtgttccaagttgctttttaaggtctgaattggaagatgaaaaagaagagatttcttctcctgatatgtgtcccagacctgagagcccagtgtttggtgccagtgggcaggaagagctagctaagagacttgctgaacttgagatcagccgagagttcctgagcgcattagatgatcaagactggtttgatgaagattttggtttgagctcttctcacaagatccaaaagaataaggcagaagaaacaatcgtacctctaatggcagaacctaagcgagcaccccagaagccatgtgagacattattggcagttccccatacggcagaggaagtagaaagccttgtccataatgcagcagaggagctttggaaatggaaagagttgggtcaggaccttcatggcctcagtcttcctaccacgttccttggtggtgccagcaaaggtctagacataggcagcacaagtagaagagtctacaaacaggcggtttttgatttaacaaaagagatttttgaggaaatatttgctgaggatcccaacgtgaatcagcctgtctggatgaagccatgcagaatcaattctagttatttccgacgtgtgaaaaatccaaataatcttgatgaaatcaagcacttcataacaaccgaagtactcaaactgcttagtctcaagaaggagccaaaccacaaaacagattggcagaaaatgatgaagtttggacggaagaaaagagaccgagtagatcacatcctggtccaggagctgcacgaggaggaggcacagtgggtgaactatgatgaggatgagttgtgtgtgaagatgcagctggctgatgggatctttgagaccttgatcaaagatactattgatgttctcaatcagatcagtgaaaagcaggggagaatgctacttgtgtga

SEQ ID NO: 425 - DNA, 12905 bp, Arabidopsis thaliana
aggtaaattggcaagatgaggagcagcaagtcaaaagaggtgcctttaccaaatcccaggaactctcagagcaaggagactattcaagtagatgtaaccacatcatgggatgcactttctcagaccaaggctgctctgagacacattgagaacaaattagaagtaactcctacaagcacagctgtaatcgattctgtgatggatactaagaagtctgcaagtgctacccgaaaaataagtaggaaagatgggagatgtctagatgattcttgggccagtgctccaacttccaaattttccaaaccacggaaagagaaatcccgtagtcctctcagggctaccaccctggaaagtaatgttaagaaaaacaatcgtgtggagttccgtgaacctttggtttcttatagggaaacccacggtacacctttcagcttaagtcccagtcatctggagtcaaagcatgtctattgtattcacgaggagaagcccgagagtgggaagcagatggtagttagtcgggaagaccggaatatccagtgctgtgattttgagagtgctcagccctcggtcatcagtgatacagttgttagatttttaaatgatggaccagcaattgatgcattgcacagttctgaatgtttaatgaaaatgggagtacatgtaagaactgaggatgaaatgcctaacagaacaaaaggaagtgagaacaattcaaagccttctcttaacaacatggaacatgatgttgatccgaaagtgatgctgctgtctgactcttctccatcctctagtgcctgtaattcccaaagatcagatatttcaaagcggcagcaacatgatattaaactggaaaaacttaaagagcggattaggaaacagtgggaacactcagaagaaataaacggccaggcccagactctaggtcatattgaccatccagtaatggttgttaatgttgacaactcggtgacaacgaaagtcaggaaagtggcaacagcaccacctgctccagcatacaaaggtttcaacccgtcagagaccaagattcgcactcctgatggaaaagtgtggcaggaggcggagtttcaaagcatgagtagagagctgtaccgagacttagcacttcagttcacagatgatacctctgtaaaagagaagcctgttgaaaaaagtaaagagaagaaagtggttaaaccagtacgaaaaatccaaaaagtgacacagttatcaaatccagaatgcaaaacaggtagcagtcgtttgataagtacatcttcttggcgagatggacaaaaattagtaaagaagattctgggacctgcacccaagatggagcaaaaagagcgaagacccacatcgaatgacagaagtggaagagaaagagtggctaaatttgggggccatattggaagagcagaatcggaccccaaattggatgtttcacataaacagcttccacgaagctcagcacgttcaagaagtagtagagcttggtctgaaactaatatagtgaaatcagctctgtcccttccagacaataagcaggaggaaagcgctgccttaaacaaggattttttgccagttgaaattcgtgggattcttgatgacttacagctagattcttcagctcaagctgtgaggcaagaggctggagagggacagaatcagaagtcatcggcccctgaacaagtacctcggagtcacagccccgtgaaaagaaagccagacaaaataacagcgaacgaggatccgcctgtgatttccaagaagcgccactatgacacagatgaggtacgacagtacattgttagacagcaggaggagaggaggaggaggcaacacgaagagaagaaggctcagaaggaggctacggagcagaagaacaaacgattacaggagctctaccggagacagagggaagccttctctaaagcaaaaactgtgcctccttctgacccattggtctctagacggcttcaggaaacttactccaaattgctactagaaaagactttgcttgaagaaccagcccgtcagcatgttacacaggacatacaggccagacctgggtatcagccatctggagaatctgataaagaaaacaaaatacaggagcgtcccccaagtgcgtcttccagtagtgacctgtccctgtcagagcctccacaacctcttgcaagaagagacttgatggagcctacatggatgcagcctgacagactgagccctcgagttcacagttctcaagcccagcccctcgctggaacgactgagaatttactctcccatctcctgcatcttgagcatgtaggaattttgcacaaggactatgaatctgttttaccagccaagaagagtcataatacggcttcaggaccgttaactttcacacctcaaccatatctgacctcacaagctcctcatccagatgccttgttgaaacctagtaccagccaatataagactaaactggatcgtattgaagccctgaaagcaacagcggcctctctgtccagtaggattgagagtgaggctaagaaactagctggggccagcattaactatgggtcagtgtggaacaccgagtgtgatgtgaagctagcacctcaagagaatggaccttggactaaagctatcagtccacctgtgaaagaggacattgaagatgctttctctgcccggattcagaagatgctgggaacctgtgtgtctcatgcagcttttgacgatgagcttcctggtgtaggcagccttagtgaatataaaaaacttcctgagatgatcagaccccagagtgccatatcaagcttacgaatgaaatcccctagtcctaagccaggagggctgctggcacagttgtgcaggaggcagacagattcttccagctctgacatacaagcctgttctcaagaaagagccaaaaggtctctttgttccagcatagactcagtcagtgaagggcctcttcttagtgaagggagtctctctgaggaagaagaacgccgggatgcacggccccttttgaaggtagcggaaattttaaaggaaaaagaattctgtgctggggagagaaactcttatgaacccatcaaagagtttcagaaagaagctgagaaattcttgccactttttgggcacataggtggtacacaaagcaaaggaccatgggaagaactggcaaagggaagtccacacagcgtcattaatatttttactaagtcatatcagttatatggaaaagggtttgaagacaggggaacattggtatcacggcctttgaatgccaccgcaaccccactcagcagcgtttcctatgaagatgattttgtctcctctccaggaagtgggacactgacagaaaggaagtcaactcttgaatcccaagttgatggtagcagcttgggcgttcaggaggagcatctgagcagacagtttgcctgtgaccttgcctctgtggatgctacctcccagcactcctcgggagctcgctctgctgggtccactcgctcctcctcagcttctaaagggaagaaggggaagaaagacaagatggactggttggattccctcactggaagtgctcagaacccactcattgatgaggaaaaagtacagtcagactcagaacgcggctcccatccaagcaggaagcttgggactggcagcaaacttgctgttggagactctgagcagactctggatgctgagagcacactggaagacctgtctgggcactctgtgagtggctcttcagacaagggaagatctcagaagactccaacttctcccctatctccaagttcacagaaattgttacagtttgaccttcctgggacttccttagaaagatctaagtcctcagtcatagtacctccaactacaactggatttaagcccactgcagcttttactgacgtgaataaaacagagatggcttcagcaccaggtcctcagcgtttctctcctgctggccttcagcatcgcatggctgcagaactcagttacctgagtgctctcgaggagtcagtgcgccagctgtccgacgtggagagagttaggggcattgccctcgctcagcaggagagtgtatctctggctcagatcataaaggcacagcagcaacgtcatgaaagagatttggccttattgaagctaaaagctgaacaggaggctttggagtgtcagagacagttagaagaaacccggaacaaaacagctcaggtccatgcagaatctttacagcaggtggttaaatcacaaagagaagtgactgaagtcctccaggaagcaacttgtaaaatagcagctcagcaatcagagaccgcgcgcctcaccacagatgcagcgcggcagatctgtgagatggcagaactaactcgaacacacctcgcagatgccatcacaacttctggagttcccctagcaacactgtacgaccaccagcggcagcattttccagacttcatgagaaaactgaggaccaaagctgaaacagataggataagtcattctgcttcacactcccagagtaaagaaggcgctgtggactccaagcggcagaagttctccccttcccgtgacagttactctgagtcttcaagatacaagagtcatgattaccggagtagtggtagcagccgacaggacagcccttccgttccacccagtaaggagaatgagaagccattccatggtgagaagatggagagctcagttgatgaacagttgcagacagccgcagatgattccttacgaagtgacagtattccgtctctgcctgatgagaaagactcaacttctattgcaacagaatactccctgaaatttgatgaatctatgacagaagatgaaatagaagaaaagtcatttcgctctctactaccttctgagagtcatcgtagatttaacatggaaaagaaaagaggccatcatgacgactcggatgaggatgcttccccagacaagactgctctgtcttctaccaaggagctgagcatgccattctcaggaggacaggatagcttttctaagttcaccatggagatggtgcggcagtacatgaaggaagaggaagtgcgcgcagctcaccagtcctcacttctgcgtcttcgagaaaaggccttaaaggagaagacaaaggccgaactagcctggctagagcatcagaaaaagcatctacgagacaaaggagaggatgataagatgcccccactccggaagaaacagcgtggtttgcttttaagacttcagcaagaaaaggcagaaatcaaacgtcttcaagaagccaataaggcagcccggaaagagaggcagctgatccttaagcagcaggaggagatcgagaggatccgccagaccaccataaaactgcaggagaagctcaagtctgcaggggagaagaaattgggctctcttgctgatgatgatgaagcagaggacaacaaggcagctagtcctgggccacccggcttggagacccgcagtccttccccgatatcgatttccagcagtgagaccagcagcatcatgcagaagctcaagagcatgagaagccgcatggacgagaagttcctgacgaagcgagaacagaagctcatgcagcgccgccagcacgcagaggagctcctggagtggaagcggcgtctggatgcagaagaagcggaaatccaacaaatggaaaaacaagctttggctgcctgggacaaagaactagtaaaacccagaactcctaagaaagaacaggagagccagagaacagagcagaaaggaatagcaagtgaagagggatcaccaatgccttcttactctccgaggaacagtgaaagttgtattccagaagacctcggcagtccttctgacttatgtgttccttctgaggctagggtacaggcacagcctgggagtccagagcacagcacacttactgaggagatggttttttcacaggagctggaatctacctctcctagcaaacattcacctcccaaaagttgcttatctatgtcaaagcaagaatctagcaaagcaagtcacaggactgaaggacactgtcatctgcctgtcaagtctcaccaaccctgttacagttggtcagatgagtcactgtctatgacacagtcagaaaccacatctgaccagagtgacattgaagggaggatcagagctctgaaggatgagctgcggaagaggaagtcagtcgtggagcagctgaagagggagcagaggaagagacagaaggagagactgaaggcccaggaggccagtctgctcagacagctggagacttatgatgaattcattaagaaaactgaaggtgaactcagccaagatctagacatatccccaacatccaaatttcaaatgaaaactctctcctccgtatccgaaaaacccaaaatcaagccacacccactacacagatctgaaacagcaaaaacttggaaatctgtaacagagtcagagcgttccagagggtccttggcatccattgctgaacatgttgattcttcattatcatgttctgagagagccatatcagaaaggtcactatctgcatatgcaaagagaggggttgagttggacagccggatagaacatttgcaagcctcatctccagatctgtcatctagaaaagcacagacagagtctagagattctcttgaaagcgcaccctcgttatctcctgtgaaggaattaaatgcacctgatcggatttatgatgtgtcagaggctaaggctgaagatactagtcagaaatcagaaatacaagaaatagagtccatgaaactggagagcagtgaggttgaagatgcctgctgtaagcagtcaggcggatctgaagtcctactgaaactagacctggcctctgaaaccctgtcaagtaaagaacttccctcagactctgcaaatgtgcagcaagacttagataaaccagccacagaaacgtctcatgaaaaagaggaagcactgaaagaggatcagtccaatcacagtacagatgaccgcagtccagacatccagtcagcaggaggcatccctgagcaaggatgcagagagagtggggactccacatgctcaggacagctttctgttcctaaagagtcgtcctactctgaagattttgaagtgtcttctttcaggaaagggatttctgctgacgagattagtaaagatgactctgaggggtcctcaccatcgtcgctcaggaaggactctcagtctcacagagataggtcacagctcacaaggagctccagaagcagagccaccgggtctggaagcgatgaggagatcagcgagtgtctcggtgagaaaagcctctctgttcatagtggcgtccactcggaaaggctgctggagctcaggtcacccacagagctaatgaagagtaaggagcgcagcgacgtggggcacgagcagggggggactgagccccttcccctggctgccacagaggagctactagatttccacattggggatagggtgttgatcggcagtgttcagccaggtactcttcggttcaaaggtgagactgactttgctaaagggttctgggctggagtggagctggacaagcctgaaggaaacaacaatgggacctatgatgggattgtgtattttgtgtgcaaagacaagcatggtatttttgctcctcctcaaaaaatatctcaccttctagaaaactttgatgatacagacataaatgaagatgaagagtcttactcagatgaacagtaccaaccctataatcaagagcagaaagatataaaatgtctaaaagacagagaaaacaatatagctgaatatttttgtgagaagtcacttcctagtatgcataatacagatgcctcagtggataaagatagaagccttaacatagaaacagatacttctgaggtcctagaggtccatggtcaccaacagccttcagtagatcctctgatttcttataaggagaacaaagtccttgtttctgatgccacagagagtgttcctgctgctgcgggtgctgctacttcagacaacacgttttctggagaatcaaagcaacagcagcttgcagagaaggaagagaacttttattctcaagttttggaaaagccctctacccctcttctggatcttttaacaagagaaaaaaaccaattagaagctcagctgaagtcatcaataagtgaagaaaaaaagtcaaagcagcaactagagacagtcagcttactaacagacagtttactacaagtctttgtgaaagacacagttagtcaactacaacaagtcaaaaaggctagaaatgagaaaatccagcttagcaatcaggagtttcttgaccaaaagaaagtaccaccccaagacctaccccaaaatactgaagaacaatcacccagtgttccaagttgctttttaaggtctgaattggaagatgaaaaagaagagatttcttctcctgatatgtgtcccagacctgagagcccagtgtttggtgccagtgggcaggaagagctagctaagagacttgctgaacttgagatcagccgagagttcctgagcgcattagatgatcaagactggtttgatgaagattttggtttgagctcttctcacaagatccaaaagaataaggcagaagaaacaatcgtacctctaatggcagaacctaagcgagcaccccagaagccatgtgagacattattggcagttccccatacggcagaggaagtagaaagccttgtccataatgcagcagaggagctttggaaatggaaagagttgggtcaggaccttcatggcctcagtcttcctaccacgttccttggtggtgccagcaaaggtctagacataggcagcacaagtagaagagtctacaaacaggcggtttttgatttaacaaaagagatttttgaggaaatatttgctgaggatcccaacgtgaatcagcctgtctggatgaagccatgcagaatcaattctagttatttccgacgtgtgaaaaatccaaataatcttgatgaaatcaagcacttcataacaaccgaagtactcaaactgcttagtctcaagaaggagccaaaccacaaaacagattggcagaaaatgatgaagtttggacggaagaaaagagaccgagtagatcacatcctggtccaggagctgcacgaggaggaggcacagtgggtgaactatgatgaggatgagttgtgtgtgaagatgcagctggctgatgggatctttgagaccttgatcaaagatactattgatgttctcaatcagatcagtgaaaagcaggggagaatgctacttgtgtgacatcttgcaaataaatcgaacactgagtgctaacatgagtcctgggcctttctgccttctgatatacaccccatctccaccatagcaagaatgcttctggaccttgaacctgttcttatggactgctggtttggagttcatgggacaatgtggtatatctggtattacagcctttgcctttacagactgtccactggattacgtggttttttcccgtgggcagggctatactctgatgctgagacttggtatcacctcattagcacccatacctactaggtctcagatgagggctgagaacaccagactgacctctgagcttagacaaagcttgagtgtcctcatgagacttgcgtctccgcaggaaagagaggtacatagattcttcttttaactttcaaaacataatcctggtctatacaatgaaactcacaaatggacatgctagtctctgaacagtattaaacccataaccactttaaaataggcaaacgcaagattgtctgcctattttacattctggagtttatttcttcttgaagaccattttcttccattcttgaagttaagcagcaccaagtggatgtcagaaataagtgggagctttgctttgggcaccacctaaaaactataacccattgcactgtgtttaattttcctgtctgggcagaacccagtgaagacgaggctccaggactgctgcgggctgttcctccgccctggtcccacccctgctctctcctcatctgtcctaacctctaccagctgctctcagaatcgtagatactcaggaccatctcaggcatccaggcatggcaaaagtggaaagacctcattttggccttcaaacgttgacttcccatctctcccgcagaagtcagtgctgttacttgaatgagttagaaaatgagtggcgcaccaaagacaagaagatcctgtccagagtctgcctgcttgtttggctctgtggaatatttttaatttattttaaggtaaattattaagttgaaaatgtgtgtccctattgagaagtgaaagattctcatcattgtaaacctccgtctcgaagcttctacagtttaatcttcgcacaggaaagctgcagttttaataaatctatacacacactgaagaagtcagttcagttcatcaaaaagacaacagacgtttacaccgtcacccgggcagcaggacaggacaggactcgaaagactaaagtttatcctgcctttcttgcagcattgcatcttacaaccattacctgcatctgaggaacatctccagactccagctgctacctttgagcacctggtgctctcctgggcccttagcacctgccttcttgactggtttctcttcatcagtcctgtccttcctaatcccagggaatgaggatgatctgaggcgtgtgtgtaaatgccttaaccctaacagtcgcggctagaacagcatggtaagacatccgctggggtcacacttacagacaccctggacattatggcttcaaaacacattagaaaacccaaagacagcgtaacccttaagtatgcacgtttgttcttttctgcatcttccttccctacttgccattgcatctctgatgtctcactctgcacacgtcactcctcttgcgtttcatcctgtcattacacaacatttgctgaaaccatcattggatatttgcattttgcacagtgactggtgtgctagctcttgacaataagaaagcactgaactgttccaattgggtctcctgaatgctcaggtgggtgtctcatcagcatctcttctgtgcttttgctgttgagctgtcgtctttagccataatgagcaggttgacgaagagaagaaaggtttctcgaggttcttagtagtgtggaaatagttttcatgtggccaatgaaagcaaagatagttctcctcagtttgtgttccttaggagacaggagacatctgtgtccatcccttgactgtttgtaggatcatattgtctttatgaaactgaactttacagctgctataagtttttttataaatgaaaatcaaattataataggaatataggttgttttccatgtcttcattatttggacctgaggttaattttttaataagacagtgtatcttttactctctacattatcatgccagaaaaggaaaaacttactgctgtaagtccataggctcagcgacctggacagtgccgagatcgtggcagtggccgtcctaacctccgctagctgtcttcactatccaagaaccctgcattccagatgcgaggcgggagtaagccagtctcctcctttgctagcaattacagctccagtttggtagcaaaaacaagtgagtctatagagttaacaggtttcttcctattttaactatttggatctaactgggtgggtttactgttagggtcaggaatgatggatgtggctgcccagccactcactcggtccacactggggtctttttaatgaagctctgcctcataaccaagaacctaagaatgccctcttcctaactttgcccctcccctacacccgcgccctcctgtctgtctgcattgattcctctaaacgatctttgcatctgcagtaataccttttagtatagcactgtcagtacctggtagtaaaccaccatggaggcttcagattgacatctgagtccaaacaatttgtgctatccagggcagttaactctgggttaaactagtacagggtatcgattccctcttcaggtctaaacaggaatttttactctagggaaaagtggaaagagctcaaaagtagtttataaggaaggtgacttccttctgtgactacaggtctctgagaaattgtctttcaaaagagattgcattgctcataagagtgttgtggcctattgataaaaacaattttgttcactttcttgtcttgaaaaaaaagtggccttagctttttgcaatacttgaataaagtgtgtacttgcaaaagaatttctgtagcacagcattagagactcataacttttctgcaagaaattcaaacttacatcttccttttactaccttaagaatactagtgaataaaacattaattcaaagagcaagtgatagaaactacaatgccgtttaatgcaaattgtaggaatttacatgtttacaaatcatcttaaactggttgtgcagcaattcaataaaatctttgtattataaaaatgtgaagaaagtgtaaaccggtgtaaaggaagcaccgttgttgtaactaagctgtggaaaagcttttccttctggactttgcaacgccttcttggttacacattgcaaagcattctctagggggctcagcctcctcgtgtgtactgtactgtgcagacatgaaaaataaacccgtttactgtgtgtgtgtaaatagcctgatcatcaggccatcttcagccaatagtcaccccctgcagcccttagacgtctgcacagaagccctagggtgtggtttgtaagtacgctctgtaaaataactgggatgaagtcccatgtatacccatgtacatagatttgttaactaaaatgtactttaagatgaaatctgtaaataaattgatttataaattaa

SEQ ID NO: 426 - protein, 3096 aa, Arabidopsis thaliana
MRSSKSKEVPLPNPRNSQSKETIQVDVTTSWDALSQTKAALRHIENKLEVTPTSTAVIDSVMDTKKSASATRKISRKDGRCLDDSWASAPTSKFSKPRKEKSRSPLRATTLESNVKKNNRVEFREPLVSYRETHGTPFSLSPSHLESKHVYCIHEEKPESGKQMVVSREDRNIQCCDFESAQPSVISDTVVRFLNDGPAIDALHSSECLMKMGVHVRTEDEMPNRTKGSENNSKPSLNNMEHDVDPKVMLLSDSSPSSSACNSQRSDISKRQQHDIKLEKLKERIRKQWEHSEEINGQAQTLGHIDHPVMVVNVDNSVTTKVRKVATAPPAPAYKGFNPSETKIRTPDGKVWQEAEFQSMSRELYRDLALQFTDDTSVKEKPVEKSKEKKVVKPVRKIQKVTQLSNPECKTGSSRLISTSSWRDGQKLVKKILGPAPKMEQKERRPTSNDRSGRERVAKFGGHIGRAESDPKLDVSHKQLPRSSARSRSSRAWSETNIVKSALSLPDNKQEESAALNKDFLPVEIRGILDDLQLDSSAQAVRQEAGEGQNQKSSAPEQVPRSHSPVKRKPDKITANEDPPVISKKRHYDTDEVRQYIVRQQEERRRRQHEEKKAQKEATEQKNKRLQELYRRQREAFSKAKTVPPSDPLVSRRLQETYSKLLLEKTLLEEPARQHVTQDIQARPGYQPSGESDKENKIQERPPSASSSSDLSLSEPPQPLARRDLMEPTWMQPDRLSPRVHSSQAQPLAGTTENLLSHLLHLEHVGILHKDYESVLPAKKSHNTASGPLTFTPQPYLTSQAPHPDALLKPSTSQYKTKLDRIEALKATAASLSSRIESEAKKLAGASINYGSVWNTECDVKLAPQENGPWTKAISPPVKEDIEDAFSARIQKMLGTCVSHAAFDDELPGVGSLSEYKKLPEMIRPQSAISSLRMKSPSPKPGGLLAQLCRRQTDSSSSDIQACSQERAKRSLCSSIDSVSEGPLLSEGSLSEEEERRDARPLLKVAEILKEKEFCAGERNSYEPIKEFQKEAEKFLPLFGHIGGTQSKGPWEELAKGSPHSVINIFTKSYQLYGKGFEDRGTLVSRPLNATATPLSSVSYEDDFVSSPGSGTLTERKSTLESQVDGSSLGVQEEHLSRQFACDLASVDATSQHSSGARSAGSTRSSSASKGKKGKKDKMDWLDSLTGSAQNPLIDEEKVQSDSERGSHPSRKLGTGSKLAVGDSEQTLDAESTLEDLSGHSVSGSSDKGRSQKTPTSPLSPSSQKLLQFDLPGTSLERSKSSVIVPPTTTGFKPTAAFTDVNKTEMASAPGPQRFSPAGLQHRMAAELSYLSALEESVRQLSDVERVRGIALAQQESVSLAQIIKAQQQRHERDLALLKLKAEQEALECQRQLEETRNKTAQVHAESLQQVVKSQREVTEVLQEATCKIAAQQSETARLTTDAARQICEMAELTRTHLADAITTSGVPLATLYDHQRQHFPDFMRKLRTKAETDRISHSASHSQSKEGAVDSKRQKFSPSRDSYSESSRYKSHDYRSSGSSRQDSPSVPPSKENEKPFHGEKMESSVDEQLQTAADDSLRSDSIPSLPDEKDSTSIATEYSLKFDESMTEDEIEEKSFRSLLPSESHRRFNMEKKRGHHDDSDEDASPDKTALSSTKELSMPFSGGQDSFSKFTMEMVRQYMKEEEVRAAHQSSLLRLREKALKEKTKAELAWLEHQKKHLRDKGEDDKMPPLRKKQRGLLLRLQQEKAEIKRLQEANKAARKERQLILKQQEEIERIRQTTIKLQEKLKSAGEKKLGSLADDDEAEDNKAASPGPPGLETRSPSPISISSSETSSIMQKLKSMRSRMDEKFLTKREQKLMQRRQHAEELLEWKRRLDAEEAEIQQMEKQALAAWDKELVKPRTPKKEQESQRTEQKGIASEEGSPMPSYSPRNSESCIPEDLGSPSDLCVPSEARVQAQPGSPEHSTLTEEMVFSQELESTSPSKHSPPKSCLSMSKQESSKASHRTEGHCHLPVKSHQPCYSWSDESLSMTQSETTSDQSDIEGRIRALKDELRKRKSVVEQLKREQRKRQKERLKAQEASLLRQLETYDEFIKKTEGELSQDLDISPTSKFQMKTLSSVSEKPKIKPHPLHRSETAKTWKSVTESERSRGSLASIAEHVDSSLSCSERAISERSLSAYAKRGVELDSRIEHLQASSPDLSSRKAQTESRDSLESAPSLSPVKELNAPDRIYDVSEAKAEDTSQKSEIQEIESMKLESSEVEDACCKQSGGSEVLLKLDLASETLSSKELPSDSANVQQDLDKPATETSHEKEEALKEDQSNHSTDDRSPDIQSAGGIPEQGCRESGDSTCSGQLSVPKESSYSEDFEVSSFRKGISADEISKDDSEGSSPSSLRKDSQSHRDRSQLTRSSRSRATGSGSDEEISECLGEKSLSVHSGVHSERLLELRSPTELMKSKERSDVGHEQGGTEPLPLAATEELLDFHIGDRVLIGSVQPGTLRFKGETDFAKGFWAGVELDKPEGNNNGTYDGIVYFVCKDKHGIFAPPQKISHLLENFDDTDINEDEESYSDEQYQPYNQEQKDIKCLKDRENNIAEYFCEKSLPSMHNTDASVDKDRSLNIETDTSEVLEVHGHQQPSVDPLISYKENKVLVSDATESVPAAAGAATSDNTFSGESKQQQLAEKEENFYSQVLEKPSTPLLDLLTREKNQLEAQLKSSISEEKKSKQQLETVSLLTDSLLQVFVKDTVSQLQQVKKARNEKIQLSNQEFLDQKKVPPQDLPQNTEEQSPSVPSCFLRSELEDEKEEISSPDMCPRPESPVFGASGQEELAKRLAELEISREFLSALDDQDWFDEDFGLSSSHKIQKNKAEETIVPLMAEPKRAPQKPCETLLAVPHTAEEVESLVHNAAEELWKWKELGQDLHGLSLPTTFLGGASKGLDIGSTSRRVYKQAVFDLTKEIFEEIFAEDPNVNQPVWMKPCRINSSYFRRVKNPNNLDEIKHFITTEVLKLLSLKKEPNHKTDWQKMMKFGRKKRDRVDHILVQELHEEEAQWVNYDEDELCVKMQLADGIFETLIKDTIDVLNQISEKQGRMLLV

SEQ ID NO: 427 - protein, 1039 aa, Artificial Sequence; identical to SEQ ID NO: 59
  alignment

SEQ ID NO: 428 - protein, 876 aa, Artificial Sequence; identical to SEQ ID NO: 53
  alignment

SEQ ID NO: 429 - protein, 2047 aa, Artificial Sequence
  alignment
KSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 430 - protein, 1304 aa, Artificial Sequence
  alignment
QLYGKGFEDRGTLVSRPLNATATPLSSVSYEDDFVSSPGSGTLTERKSTLESQVDGSSLGVQEEHLSRQFACDLASVDATSQHSSGARSAGSTRSSSASKGKKGKKDKMDWLDSLTGSAQNPLIDEEKVQSDSERGSHPSRKLGTGSKLAVGDSEQTLDAESTLEDLSGHSVSGSSDKGRSQKTPTSPLSPSSQKLLQFDLPGTSLERSKSSVIVPPTTTGFKPTAAFTDVNKTEMASAPGPQRFSPAGLQHRMAAELSYLSALEESVRQLSDVERVRGIALAQQESVSLAQIIKAQQQRHERDLALLKLKAEQEALECQRQLEETRNKTAQVHAESLQQVVKSQREVTEVLQEATCKIAAQQSETARLTTDAARQICEMAELTRTHLADAITTSGVPLATLYDHQRQHFPDFMRKLRTKAETDRISHSASHSQSKEGAVDSKRQKFSPSRDSYSESSRYKSHDYRSSGSSRQDSPSVPPSKENEKPFHGEKMESSVDEQLQTAADDSLRSDSIPSLPDEKDSTSIATEYSLKFDESMTEDEIEEKSFRSLLPSESHRRFNMEKKRGHHDDSDEDASPDKTALSSTKELSMPFSGGQDSFSKFTMEMVRQYMKEEEVRAAHQSSLLRLREKALKEKTKAELAWLEHQKKHLRDKGEDDKMPPLRKKQRGLLLRLQQEKAEIKRLQEANKAARKERQLILKQQEEIERIRQTTIKLQEKLKSAGEKKLGSLADDDEAEDNKAASPGPPGLETRSPSPISISSSETSSIMQKLKSMRSRMDEKFLTKREQKLMQRRQHAEELLEWKRRLDAEEAEIQQMEKQALAAWDKELVKPRTPKKEQESQRTEQKGIASEEGSPMPSYSPRNSESCIPEDLGSPSDLCVPSEARVQAQPGSPEHSTLTEEMVFSQELESTSPSKHSPPKSCLSMSKQESSKASHRTEGHCHLPVKSHQPCYSWSDESLSMTQSETTSDQSDIEGRIRALKDELRKRKSVVEQLKREQRKRQKERLKAQEASLLRQLETYDEFIKKTEGELSQDLDISPTSKFQMKTLSSVSEKPKIKPHPLHRSETAKTWKSVTESERSRGSLASIAEHVDSSLSCSERAISERSLSAYAKRGVELDSRIEHLQASSPDLSSRKAQTESRDSLESAPSLSPVKELNAPDRIYDVSEAKAEDTSQKSEIQEIESMKLESSEVEDACCKQSGGSEVLLKLDLASETLSSKELPSDSANVQQDLDKPATETSHEKEEALKEDQSNHSTDDRSPDIQSAGGIPEQGCRESGDSTCSGQLSVPKESSYSEDFEVSSF

SEQ ID NO: 431 - protein, 910 aa, Artificial Sequence; identical to SEQ ID NO: 56
  alignment

SEQ ID NO: 432 - DNA, 23 bp, Artificial Sequence
  alignment
attgacacaccataccacatctc

SEQ ID NO: 433 - DNA, 41 bp, Artificial Sequence
  alignment
attgacacatatctcatcataccatcaccataccacatctc

SEQ ID NO: 434 - DNA, 41 bp, Artificial Sequence
  alignment
atctcacgcgtcccaaagaaagtgatagtgtacgtacctct

SEQ ID NO: 435 - DNA, 30 bp, Artificial Sequence
  alignment
atctcacgcgtcccaagtgtacgtacctct

The invention claimed is:

1. A plant wherein the expression of a nucleic acid sequence encoding a GW7 polypeptide is increased, wherein said plant is not *Arabidopsis* wherein said plant is characterized by an increase in grain length and/or slenderness compared to a plant where the expression of a nucleic acid sequence encoding a GW7 polypeptide is not increased.

2. A plant according to claim 1 wherein said plant expresses a nucleic acid construct comprising a GW7 nucleic acid sequence comprising or consisting of SEQ ID NO: 1 or 2, a homolog or a functional variant thereof, wherein the functional variant has at least 80% sequence identity to SEQ ID NO: 1 or 2.

3. A plant according to claim 1 wherein said plant expresses a nucleic acid construct comprising a OsGW7 nucleic acid sequence comprising or consisting of SEQ ID NO: 1 or 2 or a functional rice variant thereof, wherein the functional rice variant has at least 80% sequence identity to SEQ ID NO: 1 or 2.

4. A plant according to claim 2 wherein said nucleic acid construct further comprises a regulatory sequence, wherein said regulatory sequence is selected from the group consisting of a constitutive promoter, a strong promoter, an inducible promoter, a tissue specific promoter, and a CaMV35S promoter.

5. A plant according to claim 1 with increased expression of a GW7 nucleic acid sequence comprising or consisting of SEQ ID NO: 1 or 2, a homolog or functional variant thereof, wherein the functional variant has at least 80% sequence identity to SEQ ID NO: 1 or 2, wherein said plant comprises a mutation in the promoter or coding sequence of said GW7 nucleic acid sequence.

6. A plant according to claim 1 wherein the said plant does not produce a functional GS3 polypeptide, wherein the GS3 polypeptide comprises or consists of SEQ ID NO: 7, a functional variant or homologue thereof, wherein said GS3 functional variant or homolog has at least 80% overall sequence identity to the sequence comprising or consisting of SEQ ID NO: 7.

7. A plant according to claim 6 wherein said plant comprises an RNA interference construct that reduces the expression of GS3, a functional variant or homolog thereof.

8. A plant according to claim 1 wherein said plant is a monocot or dicot plant.

9. A vector comprising an isolated nucleic acid comprising a OsGW7 nucleic acid sequence comprising or consisting of SEQ ID NO: 1 or 2 operably linked to heterologous regulatory sequence.

10. A method for increasing grain quality of a plant said method comprising increasing the expression of a nucleic acid sequence encoding a GW7 polypeptide or increasing the activity of a GW7 polypeptide, wherein said plant is not *Arabidopsis*.

11. The method of claim 10 comprising introducing and expressing in said plant a nucleic acid construct comprising a nucleic acid as defined in SEQ ID NO: 1 or 2, a homolog or a functional variant thereof, wherein the functional variant has at least 80% sequence identity to SEQ ID NO: 1 or 2.

12. The method of claim 10 comprising introducing a mutation in the promoter or coding region of a GW7 nucleic acid sequence as defined in SEQ ID NO: 1 or 2, a homolog or functional variant thereof, wherein the functional variant has at least 80% sequence identity to SEQ ID NO: 1 or 2.

13. A method for producing a genetically engineered plant said method comprising increasing the expression of a nucleic acid sequence comprising or consisting of SEQ ID NO: 1 or 2 or a functional rice variant thereof, wherein the functional variant has at least 80% sequence identity to SEQ ID NO: 1 or 2 or increasing the activity of a GW7 polypeptide comprising or consisting of SEQ ID. NO: 3, a homolog or a functional rice variant thereof, wherein the functional variant has at least 80% sequence identity to SEQ ID NO: 1 or 2, or comprising introducing a mutation in the promoter or coding region of a GW7 nucleic acid sequence comprising or consisting of SEQ ID. No 1 or 2, a homolog or functional variant thereof, wherein the functional variant has at least 80% sequence identity to SEQ ID NO: 1 or 2, and wherein said plant is characterized by an increase in grain length and/or slenderness.

14. The method of claim 10 further comprising reducing or abolishing the expression of a nucleic acid sequence encoding a GS3 polypeptide or the activity of a GS3 polypeptide.

15. A method for identifying and/or selecting a rice plant of a rice germplasm that has a phenotype selected from increased length of grain or other organs and increased slenderness grain or other organs, comprising detecting in the rice plant or the rice germplasm at least one polymorphism within a marker locus that is associated with said phenotype of said rice plant or said rice germplasm, wherein said marker locus is genetically linked with a chromosomal region comprising the nucleic acid sequence of SEQ ID NO:1, and wherein the rice plant or a progeny thereof or the rice germplasm or a progeny thereof is selected.

16. The method of claim 15, wherein the method further comprises introgressing said chromosomal region comprising at least one of said polymorphisms into a second rice plant or a second rice germplasm to produce an introgressed rice plant or introgressed rice germplasm.

17. A method of identifying alleles in rice plants or rice germplasm that are associated with improved grain quality and/or increased yield, the method comprising:
    a. obtaining a population of rice plants, wherein one or more plants exhibit improved grain quality;

b. evaluating allelic variations with respect to the polynucleotide sequence encoding a protein comprising a polypeptide comprising: SEQ ID NO: 3 or in the genomic region that regulates the expression of the polynucleotide encoding the protein;
c. obtaining phenotypic values of improved grain quality for a plurality of rice plants in the population;
d. associating the allelic variations in the genomic region associated with the polynucleotide with the phenotype; and
e. identifying the alleles that are associated with improved grain quality.

* * * * *